United States Patent 9,592,283 (IMMUNOLOGICAL COMPOSITIONS CONTAINING ATTENUATED HISTOPHILUS SOMNI) - sequence listing, part 5

SEQ ID NO: 5 - DNA, 2263460 bp, Histophilus somni (TK #34)
  misc_feature (38928)..(39086): n is a, c, g, or t
  misc_feature (43157)..(43161): n is a, c, g, or t
  misc_feature (77308)..(77308): n is a, c, g, or t
  misc_feature (80524)..(80539): n is a, c, g, or t
  misc_feature (81448)..(81473): n is a, c, g, or t
  misc_feature (81784)..(81826): n is a, c, g, or t
  misc_feature (81859)..(81876): n is a, c, g, or t
  misc_feature (82104)..(82170): n is a, c, g, or t
  misc_feature (84295)..(84339): n is a, c, g, or t
  misc_feature (86322)..(86418): n is a, c, g, or t
  misc_feature (91961)..(92672): n is a, c, g, or t
  misc_feature (96616)..(98185): n is a, c, g, or t
  misc_feature (243582)..(255820): n is a, c, g, or t
  misc_feature (256433)..(257522): n is a, c, g, or t
  misc_feature (257661)..(258056): n is a, c, g, or t
  misc_feature (258926)..(259101): n is a, c, g, or t
  misc_feature (259180)..(259804): n is a, c, g, or t
  misc_feature (260714)..(261039): n is a, c, g, or t
  misc_feature (262175)..(263517): n is a, c, g, or t
  misc_feature (285906)..(286768): n is a, c, g, or t
  misc_feature (287250)..(289005): n is a, c, g, or t
  misc_feature (289594)..(290966): n is a, c, g, or t
  misc_feature (291238)..(291733): n is a, c, g, or t
  misc_feature (292073)..(293926): n is a, c, g, or t
  misc_feature (294031)..(294148): n is a, c, g, or t
  misc_feature (295625)..(295842): n is a, c, g, or t
  misc_feature (296048)..(296661): n is a, c, g, or t
  misc_feature (296921)..(297748): n is a, c, g, or t
  misc_feature (297804)..(297833): n is a, c, g, or t
  misc_feature (318228)..(318862): n is a, c, g, or t
  misc_feature (362392)..(362431): n is a, c, g, or t
  misc_feature (362551)..(363728): n is a, c, g, or t
  misc_feature (368685)..(368685): n is a, c, g, or t
  misc_feature (371510)..(371626): n is a, c, g, or t
  misc_feature (381141)..(381225): n is a, c, g, or t
  misc_feature (381249)..(381424): n is a, c, g, or t
  misc_feature (382320)..(382566): n is a, c, g, or t
  misc_feature (422691)..(423002): n is a, c, g, or t
  misc_feature (423130)..(423193): n is a, c, g, or t
  misc_feature (424286)..(424482): n is a, c, g, or t
  misc_feature (424688)..(424797): n is a, c, g, or t
  misc_feature (425943)..(426203): n is a, c, g, or t
  misc_feature (426465)..(427042): n is a, c, g, or t
  misc_feature (429237)..(429237): n is a, c, g, or t
  misc_feature (429250)..(429429): n is a, c, g, or t
  misc_feature (429705)..(429749): n is a, c, g, or t
  misc_feature (429798)..(429942): n is a, c, g, or t
  misc_feature (513658)..(519397): n is a, c, g, or t
  misc_feature (519781)..(524877): n is a, c, g, or t
  misc_feature (549620)..(549721): n is a, c, g, or t
  misc_feature (552635)..(553381): n is a, c, g, or t
  misc_feature (559245)..(568107): n is a, c, g, or t
  misc_feature (614859)..(614859): n is a, c, g, or t
  misc_feature (614920)..(618334): n is a, c, g, or t
  misc_feature (630127)..(634450): n is a, c, g, or t
  misc_feature (664966)..(665370): n is a, c, g, or t
  misc_feature (665525)..(665879): n is a, c, g, or t
  misc_feature (672627)..(677067): n is a, c, g, or t
  misc_feature (692212)..(701591): n is a, c, g, or t
  misc_feature (708739)..(709204): n is a, c, g, or t
  misc_feature (747209)..(747340): n is a, c, g, or t
  misc_feature (747495)..(753332): n is a, c, g, or t
  misc_feature (753743)..(760165): n is a, c, g, or t
  misc_feature (760866)..(761271): n is a, c, g, or t
  misc_feature (761330)..(761558): n is a, c, g, or t
  misc_feature (761677)..(775049): n is a, c, g, or t
  misc_feature (775198)..(777453): n is a, c, g, or t
  misc_feature (777689)..(780245): n is a, c, g, or t
  misc_feature (780488)..(780821): n is a, c, g, or t
  misc_feature (781085)..(781395): n is a, c, g, or t
  misc_feature (782027)..(782087): n is a, c, g, or t
  misc_feature (782254)..(785190): n is a, c, g, or t
  misc_feature (797652)..(799415): n is a, c, g, or t
  misc_feature (807005)..(807005): n is a, c, g, or t
  misc_feature (807008)..(807008): n is a, c, g, or t
  misc_feature (807017)..(807105): n is a, c, g, or t
  misc_feature (807197)..(807315): n is a, c, g, or t
  misc_feature (807700)..(811147): n is a, c, g, or t
  misc_feature (811386)..(811427): n is a, c, g, or t
  misc_feature (811784)..(811784): n is a, c, g, or t
  misc_feature (811790)..(811790): n is a, c, g, or t
  misc_feature (811808)..(811808): n is a, c, g, or t
  misc_feature (811810)..(811810): n is a, c, g, or t
  misc_feature (811814)..(811814): n is a, c, g, or t
  misc_feature (815067)..(815068): n is a, c, g, or t
  misc_feature (862751)..(863417): n is a, c, g, or t
  misc_feature (869786)..(869910): n is a, c, g, or t
  misc_feature (914711)..(914735): n is a, c, g, or t
  misc_feature (916950)..(919574): n is a, c, g, or t
  misc_feature (924497)..(924845): n is a, c, g, or t
  misc_feature (925160)..(931915): n is a, c, g, or t
  misc_feature (953961)..(954135): n is a, c, g, or t
  misc_feature (969830)..(969854): n is a, c, g, or t
  misc_feature (973111)..(973225): n is a, c, g, or t
  misc_feature (973306)..(973306): n is a, c, g, or t
  misc_feature (973768)..(973867): n is a, c, g, or t
  misc_feature (974035)..(974132): n is a, c, g, or t
  misc_feature (974176)..(974411): n is a, c, g, or t
  misc_feature (974578)..(974743): n is a, c, g, or t
  misc_feature (975186)..(975286): n is a, c, g, or t
  misc_feature (976981)..(977058): n is a, c, g, or t
  misc_feature (977296)..(977468): n is a, c, g, or t
  misc_feature (977551)..(977574): n is a, c, g, or t
  misc_feature (977690)..(977756): n is a, c, g, or t
  misc_feature (978049)..(978049): n is a, c, g, or t
  misc_feature (978176)..(978295): n is a, c, g, or t
  misc_feature (978381)..(978430): n is a, c, g, or t
  misc_feature (978629)..(978679): n is a, c, g, or t
  misc_feature (981649)..(981727): n is a, c, g, or t
  misc_feature (981832)..(983093): n is a, c, g, or t
  misc_feature (985980)..(990273): n is a, c, g, or t
  misc_feature (991468)..(992180): n is a, c, g, or t
  misc_feature (1001011)..(1002293): n is a, c, g, or t
  misc_feature (1003444)..(1004464): n is a, c, g, or t
  misc_feature (1005002)..(1005882): n is a, c, g, or t
  misc_feature (1006951)..(1007809): n is a, c, g, or t
  misc_feature (1008027)..(1008530): n is a, c, g, or t
  misc_feature (1008590)..(1009438): n is a, c, g, or t
  misc_feature (1009474)..(1014532): n is a, c, g, or t
  misc_feature (1014601)..(1018504): n is a, c, g, or t
  misc_feature (1018718)..(1019175): n is a, c, g, or t
  misc_feature (1020779)..(1022282): n is a, c, g, or t
  misc_feature (1022324)..(1023459): n is a, c, g, or t
  misc_feature (1024283)..(1025040): n is a, c, g, or t
  misc_feature (1030869)..(1033350): n is a, c, g, or t
  misc_feature (1035166)..(1035904): n is a, c, g, or t
  misc_feature (1047103)..(1047857): n is a, c, g, or t
  misc_feature (1048976)..(1049130): n is a, c, g, or t
  misc_feature (1052607)..(1052737): n is a, c, g, or t
  misc_feature (1070850)..(1071023): n is a, c, g, or t
  misc_feature (1071138)..(1071389): n is a, c, g, or t
  misc_feature (1082409)..(1084878): n is a, c, g, or t
  misc_feature (1090981)..(1090981): n is a, c, g, or t
  misc_feature (1169966)..(1169966): n is a, c, g, or t
  misc_feature (1170095)..(1170331): n is a, c, g, or t
  misc_feature (1170914)..(1171103): n is a, c, g, or t
  misc_feature (1171184)..(1171406): n is a, c, g, or t
  misc_feature (1172147)..(1172235): n is a, c, g, or t
  misc_feature (1172674)..(1173803): n is a, c, g, or t
  misc_feature (1173847)..(1174692): n is a, c, g, or t
  misc_feature (1174800)..(1175744): n is a, c, g, or t
  misc_feature (1175941)..(1175974): n is a, c, g, or t
  misc_feature (1176060)..(1176060): n is a, c, g, or t
  misc_feature (1177260)..(1177532): n is a, c, g, or t
  misc_feature (1177629)..(1177931): n is a, c, g, or t
  misc_feature (1179401)..(1179496): n is a, c, g, or t
  misc_feature (1188712)..(1190153): n is a, c, g, or t
  misc_feature (1190523)..(1192880): n is a, c, g, or t
  misc_feature (1193095)..(1195499): n is a, c, g, or t
  misc_feature (1301862)..(1306266): n is a, c, g, or t
  misc_feature (1306312)..(1313076): n is a, c, g, or t
  misc_feature (1315988)..(1316012): n is a, c, g, or t
  misc_feature (1316046)..(1319432): n is a, c, g, or t
  misc_feature (1319510)..(1323302): n is a, c, g, or t
  misc_feature (1323882)..(1329961): n is a, c, g, or t
  misc_feature (1340125)..(1352087): n is a, c, g, or t
  misc_feature (1368237)..(1368949): n is a, c, g, or t
  misc_feature (1369642)..(1369827): n is a, c, g, or t
  misc_feature (1370063)..(1370248): n is a, c, g, or t
  misc_feature (1417304)..(1419039): n is a, c, g, or t
  misc_feature (1419732)..(1419951): n is a, c, g, or t
  misc_feature (1421479)..(1421530): n is a, c, g, or t
  misc_feature (1422561)..(1422561): n is a, c, g, or t
  misc_feature (1425344)..(1425344): n is a, c, g, or t
  misc_feature (1425471)..(1426078): n is a, c, g, or t
  misc_feature (1426175)..(1426395): n is a, c, g, or t
  misc_feature (1426822)..(1426822): n is a, c, g, or t
  misc_feature (1427406)..(1427794): n is a, c, g, or t
  misc_feature (1428501)..(1428512): n is a, c, g, or t
  misc_feature (1441632)..(1441911): n is a, c, g, or t
  misc_feature (1443262)..(1444080): n is a, c, g, or t
  misc_feature (1530876)..(1532616): n is a, c, g, or t
  misc_feature (1535194)..(1535205): n is a, c, g, or t
  misc_feature (1599159)..(1599165): n is a, c, g, or t
  misc_feature (1599456)..(1601708): n is a, c, g, or t
  misc_feature (1647215)..(1647264): n is a, c, g, or t
  misc_feature (1649423)..(1650928): n is a, c, g, or t
  misc_feature (1684434)..(1684618): n is a, c, g, or t
  misc_feature (1689806)..(1689923): n is a, c, g, or t
  misc_feature (1690730)..(1690930): n is a, c, g, or t
  misc_feature (1693866)..(1693866): n is a, c, g, or t
  misc_feature (1695055)..(1695235): n is a, c, g, or t
  misc_feature (1704896)..(1704984): n is a, c, g, or t
  misc_feature (1747205)..(1748886): n is a, c, g, or t
  misc_feature (1749437)..(1751545): n is a, c, g, or t
  misc_feature (1751943)..(1754639): n is a, c, g, or t
  misc_feature (1770194)..(1770829): n is a, c, g, or t
  misc_feature (1770917)..(1771339): n is a, c, g, or t
  misc_feature (1771460)..(1771533): n is a, c, g, or t
  misc_feature (1771742)..(1772014): n is a, c, g, or t
  misc_feature (1772129)..(1772549): n is a, c, g, or t
  misc_feature (1772975)..(1773260): n is a, c, g, or t
  misc_feature (1773301)..(1773914): n is a, c, g, or t
  misc_feature (1774048)..(1774176): n is a, c, g, or t
  misc_feature (1806544)..(1806565): n is a, c, g, or t
  misc_feature (1806974)..(1806974): n is a, c, g, or t
  misc_feature (1807130)..(1808779): n is a, c, g, or t
  misc_feature (1809284)..(1809415): n is a, c, g, or t
  misc_feature (1809467)..(1809773): n is a, c, g, or t
  misc_feature (1809796)..(1809796): n is a, c, g, or t
  misc_feature (1811280)..(1811842): n is a, c, g, or t
  misc_feature (1814632)..(1814644): n is a, c, g, or t
  misc_feature (1816480)..(1816586): n is a, c, g, or t
  misc_feature (1817524)..(1817833): n is a, c, g, or t
  misc_feature (1859202)..(1859330): n is a, c, g, or t
  misc_feature (1865853)..(1866303): n is a, c, g, or t
  misc_feature (1866489)..(1866895): n is a, c, g, or t
  misc_feature (1869364)..(1869792): n is a, c, g, or t
  misc_feature (1870894)..(1871330): n is a, c, g, or t
  misc_feature (1872655)..(1873924): n is a, c, g, or t
  misc_feature (1874786)..(1875256): n is a, c, g, or t
  misc_feature (1875517)..(1875737): n is a, c, g, or t
  misc_feature (1876080)..(1877886): n is a, c, g, or t
  misc_feature (1882795)..(1884663): n is a, c, g, or t
  misc_feature (1885071)..(1885960): n is a, c, g, or t
  misc_feature (1886101)..(1886213): n is a, c, g, or t
  misc_feature (1887008)..(1889223): n is a, c, g, or t
  misc_feature (1892371)..(1892385): n is a, c, g, or t
  misc_feature (1892564)..(1893105): n is a, c, g, or t
  misc_feature (1893486)..(1895200): n is a, c, g, or t
  misc_feature (1913714)..(1919322): n is a, c, g, or t
  misc_feature (1922630)..(1923406): n is a, c, g, or t
  misc_feature (1924718)..(1925817): n is a, c, g, or t
  misc_feature (1926062)..(1926294): n is a, c, g, or t
  misc_feature (1971545)..(1978046): n is a, c, g, or t
  misc_feature (1980864)..(1985740): n is a, c, g, or t
  misc_feature (2024482)..(2024484): n is a, c, g, or t
  misc_feature (2038900)..(2039005): n is a, c, g, or t
  misc_feature (2041480)..(2041865): n is a, c, g, or t
  misc_feature (2042038)..(2043416): n is a, c, g, or t
  misc_feature (2043560)..(2043760): n is a, c, g, or t
  misc_feature (2044175)..(2044252): n is a, c, g, or t
  misc_feature (2044444)..(2044557): n is a, c, g, or t
  misc_feature (2044811)..(2044872): n is a, c, g, or t
  misc_feature (2046001)..(2046001): n is a, c, g, or t
  misc_feature (2066186)..(2066678): n is a, c, g, or t
  misc_feature (2118906)..(2119519): n is a, c, g, or t
  misc_feature (2119792)..(2123257): n is a, c, g, or t
  misc_feature (2123309)..(2123363): n is a, c, g, or t
  misc_feature (2123950)..(2123974): n is a, c, g, or t
  misc_feature (2124903)..(2126281): n is a, c, g, or t
  misc_feature (2128914)..(2128983): n is a, c, g, or t
  misc_feature (2129050)..(2131629): n is a, c, g, or t
  misc_feature (2131910)..(2143906): n is a, c, g, or t
  misc_feature (2160506)..(2163041): n is a, c, g, or t
atcaaaaacaacgctcatcaaaaattaagaatcggaattctaatcttaaattcagcgttcgtcaaatcagaatagtcaaaatcgcagaataaagcttatttttccaatcaaaaagcacaagagcggctcggattatacgtttttttacaaaaatctcaagcaacctttttcagtttttttgttcttttaataaagatctttgagccagtttattgtagaattaccgtcaatttacaccgcacttttagataaaacttccaactatttaatttgcaaagatggataaaatgagttcaacagtttctacgctatggcgagattgcttattacaattacaagatcaagtatcttcaaatgactttacgacttggctacgaccattacaggacgatgtcagtgagagtaacatgatactttatgcaccaaattgtttcattaaaggatgggttgaaaatcattatctcactcaaatcacaaagcttgctcagcaattgttgaataatgatcaattcatggtaaagatacaagacggcataaaacctactgagaaaacaacaacgaatgttgagcaaaagacacaaaatgaaaactgtcataatgaaataacttcgcaacaaaattaccgctcttatctcaataaaaatcatgtctttgataactttgttgaaggtaaatccaaccaattggcacgagcagttgcccagaaagtggctaaaaatccgggtgagcaaagtgctaatccattgtttttgtatggtggtacaggtctaggcaaaacgcacctgttgcatgctgtaggaaacggcattttagcaaataatcctcatgctcaagttgtttatatgcatgcagaacgttttatgcaatcttatgtaaaagccttaaaatccgatagaatggacagttttaagcgattttatcgtactgttgatgccttactgattgatgatattcaattttttgccggtaaagatggtacgcaagaagaatttttccatatattcaactcgttatttgagcgtggtcgccaaattattttgacttctgatcgttatccgaaggaaattgagaaaattgaagatcgtttaaaatctcgtttcggttggggaattagtgttgctattgaacctcccgaattggaaaccagagtcgcgattttgttgaagaaagcggaagaaaaaaatatggttttacccgaagaggtcgccatgtttattgggggaaaattacgtactaatgtgcgagaattagaaggtgcattaaaccgtgttcatgcacatgcggaatttaccggaaaagcgattactattgattttgtacgtgaaactctaaaagacatgttggcattgcaagataaattggtaacaattgaaaatattcaaaaaattgtggctgattattatcggatcaaaatttcggatttaaaatcaaaaagacgttcacgtaatataaccagaccacgtcaattagctatggcattagctaaagaactaacgaatcgcagtcttcctgaaattggtaggaatttcggtgatcgggatcatacgaccgttctgcatgcttgtaaggccatagcaaaactcagagaagaagataatggtatccaagaagattggtcaaatttaatccgcacactgtcagtataagggagcagactatgcaatttattgtttcaagagaacatctattaaaaccattacaacaagtttgtggtgtattaagtagtcgtccaaattttcctatattaaacaatgtattattgcaaattgaggggaatgttttacgtattaccggtacagatctcgaagtagaactttcaacacaagcacaacttattcaagcatcgcaagacggtagttatacgattccggcaaaaaaattcttagatatttgccgcagttttcccgatgaagcggaaattaccgtaacttttgaagaagaacgtgctttggtgagatccggtcgaagtaaatttaatttaaccgctttacctgcagacgaatatcctaatttagctgattggcaatcagaggtggatttttacctgcctcaaagtacattacgtcgtctaattgaagcaacacaattctctatggcaaaccaagatgctcgttatttcctaaacggtatgaagtttgaaactgaaggcaatttactacgaacagttgctactgatggacatcgactcgccgtttgcacaattccgttagagcaggatttgcatacacatgcagtcattttgcctcgcaaaggaatattagagttaatgagattactggaaaacagcgaacacgctgctcacgttcaaattggcacaaataatttacgcattgatttaggaagtattatttttacatcaaaattaattgatggtcgtttcccagactatcgtagagttctcccaagaaatgcaactcatattatggaaggtaattgggaactgctgaaacaagcttttgctcgtatggcaattctgtctagcgataaagttaaaactgtccgtttgcaattgacctcaaatcaattaaagattacagcaacaaatccggaacaagaagtggctgaggaaattttagatgtcgtatataatggggcagatatggaagttggctttaatgtgagttacattttagatgtacttaatgccctaaaatgccaacaggtgcgattatgttttactgatgcctcatcaagttgtttattagaggatgctgatgatgaaagtgcagagtatgtcgttatgccgatgcgtctataaacaatggcaatatcacgcttaatcatcaatcatttccgcaacttaacagccatagatctggaatttgaacgtggctttaactttattattggcaacaatggaagcgggaaaacaagtttactggaagctattttttatttagggcatggacgctcatttaaaagtgcggttgcaaatagaataatttcttatcagcaaccgcactttattttacatggtaaaattcaagagcaacaacatcaatggtctgttggtttgcaaaaacaacgtcaaggtaacactttaatgaaaataaacggcgaggacgcaaaaaaaatttccgatcttgcccatttattgcccatgcaactcattacacctgaaggattaaccttattaaatggcggtcccagctatcgaagggcttatttagattgggggttatttcatcataacgcatcattttataatgcttggagtagcttaaatcgtttacttaaacaacgaaattctgccttacaacaagtttgttcttatgaaaaactcaaaatttgggatagagaattaaccaaacttgcttatcaagtgagctactggcgagaagcgtatgcggaagctttacgctcggaaatagaaaaaacctgtcagctttttctacctgaactagaaatttctgttagctttcatcaaggctgggataaaaatatggactatgcggatctgttacaacaaaattttgagcgagatcgtgctttgggttataccttttccggacctcaaaaagcagattttcgttttaaagcaaacggattgccggctgaagatattttatctcgtggacaattaaaattgttaatgtgtgcattacgtttggctcaaggtgagcatttaatgcaacaaaaaaaacgccactgtatttttctacttgacgatttcgcttcagaattggatcaatataaacgcacattgcttgctgaacgcttacaaaaaaatggttcgcaagtttttgttactgcaataactcaagaacaattacaacagatacaaccagaaaagcaccgcactttttaccttgaaaacggaagaataaaagatttttaaaataagcaaaaaacaaaactgaccaattgtcaggcttcacatagcgttataaagatttatcttgtaccatacacaacaatagttttgccatgtgctgaaattaaatgctgatcttctaacattttcaaaatacgcccaacagtttctcgtgagcaacctaccatttgtcctatttcctgacgagtaattttaatttgcataccgtccggatgagtcattgcatcaggcatcttagctaaatttaacaaggtttgagcgatacgacctgtcacatctaaaaatgccaaattgcttacctgctttgaagtattttgtaaacgatgagctaattgaccggctaaatacattaaaatttctggattaacttgaattaattggcgaaattttttataagaaatttctgcaatttcacatgagcttttagctttaacccaagccgaacgaggctgtgtttcatcaaataaaccagcttcgccaaaaaaatcaccttgacttaaataagtcaaaatcatttctttaccttcctcatcttttaccatcacggcaacagaccctctaattaaataataaagggtttccgccttttctccagcatgaatgagggagctttttgctgagtatttatgaatgtgacaatgagataggaaccactctaacgtcggatccatcgatggtgctgattgtccttgttgttctaacataaaatctcctagtcattttccatttaaaaaatccattttatttttaatatcaatggattgatgtaactcagaccaaaccagtatcgctttcccctgacgaatgtttttaaataaattttctcttttttcggctaatgaaagctcggtactaccataatccgtaccttcacgtaaaataaagctatccacaatatttaataaggtttgctcttctaatttttcccatggaataagcattgcaaattgctccaatcttacctaaaaatttctattatgcaaataaactttccagcagtttccattgttgctcaaaaccttgattaggcaagtgcctaaagttatttcttacgtaacgcataaactgtccttcgcataaagtaacaagatgggaagcaataattttttcatcaagatgaaaagattttccttctctcaatttacgcatttgtagaatattcacaaactgtaattctaaacgatcaaaaaatcgtgcaactcgtgcttgtaactgactatcttcaaacattaaagcatgccctgttaaaattcgggttaatcccggattttttcgtgcaaaatcaagaatagtttgcaaaatatctctcacacgattcatggtattggtttcgttcttgatagagtgattaattcgactaaataaagtattttctatattatccaataatgcttcaaacattttggttttactgggaaaataacggtaaagtgcggcttcagaaacaccgacttcctgtgccaagcgagctgtcgtcatacgctccattcctcgttctgaatgtaacatatgggttagtacggttaatacctgttgacgacgttcttttactgttcgtttctcaattttttgcgttttttgttttgaggcaacaacgatttcagcatcgccaatatccaattgctgttgttccattattttttgcctgaatgaccaaaaccaccattaccacgatctgtttgctgaaattcttctacaatattgaactcagcttgtactacaggtacaaacactaattgtgcgatacgatcaccaatttcgattttgaaaggtttatcacttcgattccaaagagaaaccatgagtggaccttgataatctgaatcgattaaaccaactaaattgcctaatacaatcccatttttatgtcccaatcctgaacgaggcaaaatcactgctgctaaattaggatctgcaatataaatagataaacctgttgaaataagttttgtttctcctggctggacttcaaatccctcgtcaaccaacgctcgtaaatccaatcctgccgatcctatggttgcataagttggtaatggaaactcagttccaatacgtggatctaaaatttttacatcaatctttttcatttactttcttccaatttccatttataacgcacaataattttatcaaccaattgtttagctaagtcacttttatgtttcaatgccaacctctcttgcccattttgccaaaacagctgcaattcgttttgctctgaattaaatacttgcccaccggaaacatcatttgcacaaatcatatccaaatttttacgttgtaatttgtctttcgcatactgctccacattttgtgtttcagccgcaaatcctacaacaaaaggacgattttccattaaattggctacagttgcaagaatgtctggatttttgaccaactttaagaccatttcatcattaccggggattttcttaattttttgttctgcaatttgttctacacgataatcagctaccgctgcacaaccaataaaaatctgattttgttccgcactttgtattgcatgttgatacatttcttgtgccgaaactacattaatgcgttgtacattatgaggtgtcgctaaattgacaggtccactgattaaagtgacttttgcacctcgttgagcaaaagcttcagcaatagcaaaccccattttgcctgagctatgattactaatatagcgtaccggatcaatggcttctcttgttggacctgcggtaatcacaacacttacatcaagtaaatcttgagtatgtaaaaaggattggcaaagtgcggtaaaaatttcaaaaggttctgacattcttccgatacctacatcaccacaagcctgttcaccactattcggtccgataaactgcacaccacgagccatgagttgtgctaaattttgttgagtaacagtttgtgcatacatttgttggttcattgccggagccagaaaaatcggagaattcgttgctagacaaatagtggataataaatcgtttgccataccgaccgccatgcgtgcaataaagtctgcactggcaggtgcaattacgataagatccgcccacttagccaattcaatatgtcccattgccaattcagcttcatgatcaagtaaagattgtgatacagcgttgccggaaattgcttgtaaagttaaagctgttacaaattctgtcgctgcatttgttagcactactcgaacttctgcttgtgctttacgcaataaacgaattaattctatggttttatatgcagcaataccgccggtaattccaatgacaattcgttttccccgaataagattttgcattgttagtccttaatcacaatccaaagtgcggtcattttactgcaatttttcataagaaaacatttaattttgcgattttgcacgcaaaataaaaaatacagtatttaaaacagcaacaaatcccttcatctttatcgttaaatattttttcctttgctaacaagaattttctatgacacaacaaaatacaactttaatgccgagagaaaaactactgaaatatggagcttcatcacttgatgataaggaattattagcgattttcttacgtacaggtataaaaaattgtcctgttatgcaactctccgagttggtacttgctcatttttcttctttaagaggattaattaatgcagatcaaaagcatttttgccaaatgaaaggattgggtattactcaatttgtacaattacaagcctgtactgaaatgaccaaacgttatctcttacaagaattacagtttgcacaagaatttaccagccctgatacggttcgtatgtatttacagactgaattagaaaataaagatagagaaatttttatggtactgtttttggataatcaacatcgtttaataaaaaaagaggaaatgtttttaggtaccattaaccaggcaaatgtttatcctcgtgagattattaaaaccgcactattttgtaatgcagccgcacttattcttgcacataatcatccttccggtgtttcaacgccaagcatggcagacagaaaaatgaccgagaatataaaacaactatcagaattaatggaaatccgtgttttagatcattttatcattggtaaaggtaactatttctcctttgcagaacaaggctggatctaggatcattcgatgaattattcaatctatttgcgtaaatttttatcatttttttcagggaatttatctatttaggcttgagaatgataaacaaaggtcgtataattcacgacctttaatatagtgggtcggctatgcgacctgacgaggtagccttcaaaatcttgaattttgaagtggtccgaaccctaagctcgagcttatatttttattggagattaatatgtctagagtctgtcaagtaacaggcaagcgtccagcagttggtaacaaccgttcgcacgcaatgaatgcgactcgtcgtcgttttcttcctaacttacacactcatcgtttttgggttgagagtgaaaaacgtttcgtaactttacgcttaacagcgaaaggtatgcgtattattgataaaaaaggcattgatgcagtgttggctgaaatccgtgctcgtggcgagaaaatctaaggagctaaaaaatggcagctaaaggtgctcgtgaaaaaattcgcttagtttcaacagctgaaacaggtcatttttatacaacgactaaaaataaacgcaatatgccggaaaaaatggagatcaaaaaatttgatccggttgtgcgtaagcatgttatttacaaagaagctaaaatcaaataatttagttttcacgataaaaaagcccgacatgttcgggttttttattttttcaaattttactttttgccataagatagctgaaagacttactcttggaaaaaaaacatgcctgaattacctgaagttgaaacaaccttaaagggcgtaagcccttatttaaaagggtttataattgaaaaaatagtagtacgtaatcccaaattacgctgggaagtaagtaaagaactcagcacatttaaacacgttaaaattcttaacttaactcgtcgagccaagtatctcattatccacacggaacaaggttacattatcggacatttaggtatgtccggttcagtccgcattgtgccgcatgacaatcctgtcaataagcatgatcatttcgatattgttatgaacaacggcaagttactacgctataacgatgctcgtcgctttggtgcttggctatggacgaataaccttagtgaatttcatctttttttcaagttggggccggaacctttatctgaaacgtttaattctgcttatttgttcaaaaaatctcgtcaaaaaagcaccgcacttaaaactttcttgatggataattccgttgttgtaggggttggaaatatttatgcgaatgaaattttatttctatgtggacttcatccacaaaagatcgccaaaacattgacaaaaaaacaggctgaacaacttgttttcactattaaacaagtgcttaacgaagctattgaacaaggaggaacaaccctaaaagattttttacaacctgacggtcgccccggatattttgctcaaaaacttttggtttatggaaataaggacaagccttgtccaaggtgcggtacaaagataaaaagtattattattgggcaaagaaatagctttttttgtccgcaatgtcaaaaaaagtgacattactttctttgttttttaaaaaaaatatgttaaacatcaataatgtctttttattttcacaatcagtaaacgcaaaaaggaatatgtaatgaatggagcaaatttggtcgtagaatgtttaaaagctcacggcgtaacttccttatttggctatcccggtggggcgataatgccagtttatgatgcaatttatgattctggtttagatcatctactttgtcgtaatgagcaaggtgcagcaatggctgctattggatatgcaagatcaacaaataaagtcggtgtttgtgttgcgacgtcgggaccgggggcaacaaatttaattaccggtttaggtgatgccttgatggattcaattcccattattgcaattaccggacaagttgcctcaaattttattggtacagatgctttccaggaagctgatattcttgggttgtcacttgcctgtactaagcacagttttatcgttcaacatattgatgaattacctgaaatcattgcgaaagctttccaaattgcacaaagtggtcgccccggtcctgtgcttattgatcttccaaaagatgtgcaatttgcacctacatccttaaaacccattgtttatcccaaaattgcggattctttacaaaatttagtcgcacttgagcaagcgaaaaatttactttctcaagcaaaacgccctgtgctttatgtaggtggcggtgttggaatggcaaaaagctcggatggtatgagtggcgtaaaagctatacgcacttttcttgatataacaaatattccatcagtatcaaccttaaaaggtttaggaacaatacctcccaaacatccactctatatgggaatgattggaatgcacggtacaaaagcggcaaattatgctgtgcaagaatgtgatttacttattgcttgtggggcaaggtttgatgatcgtgtaacgggaaaattagatacgtttgcaccacatgctaaagttattcatattgatattgatgttgctgaaattaacaaactccgtaaagcagatgttggactacaaggggatttggtggaggcggttactaaccttgcccaactattggatattgaaccgtggcgtaaagatattgagcagttaaaagcaagttttgattttaattatattgaaaatacagaagataaagagatagagccctgtgcattacttcacacattatccgaacgcaaagcaaaaaatgcggtgattacaactgatgtagggcaacatcaaatgtggtcggcacaacatatgaaacattatgaacctgaaaattatattacatctgcagggttcggttcgatgggcttcggcttgccggcagctatcggtgcggcaaaagctcgtccccaagatccagttattttaattactggtgatggctcattgatgatgaatattcaagaattgggttcgatcaagcgtggaaatttaccaatcaaaattttattgcttgataaccaacgtttgggtatggtgcgacagtggcaatcgctcttttttcatggtcgccatagccacactgttttagatgataatcctgattttgttactcttgcttctgcctttggtattgcaggtgaacgaattgaaaaggcaagtgaagtttccgatgctttggatcgattattaaatgccaaagaagcttatttactacatgtctgtatcccagatgaagaaaatgtatggccacttgtaccgccaaatacatgtaacagtaatatgattgaagaagatattggggtgtaaacaatgaaaacttacgatttaactattcaagcaaacaaacgccctgaaactttagagcgtttgttaagagttgtccgccatcgtggttttgaagtcattattctacatagtgaaagtaaaggtaatgttattgatttgagacttactgtgcaaagtgagcgagctattgaattattgattcaccaattagtgaaattaccggatgttattacattaagctaaagagcggtctaaatttgtataaattattatacaaaatagatggttagtttaaagggagataagttgtggaaggtgctgttttagcgattaaattgggattggttgaagagattgtttttgaaaatggttcaaagatgtcaacggcaattcggaaaaaaccgatggaacaagctatcgttcatgaattaggtgcggaaggaaatgatgttggactgaaagcacatcatggaggcattgataaagcactgttttttatggctgaaagatcttttgctaaattaaccgctcttttgggtaagcatgatagctatcaaggagaagctatctatggtgaaaattttattgtttctttttttgatgaagaaaatgtatgtgtcggcgatcagtaccagatcggagatgtacaaattgaaatttcacaacctcgcataccttgtgaaacgttgtcaaaaaatgccaataataaaaatactcgagcgattgttgtagaaacagggctgaccggttggtatgtgagagtcattaaaaatggcgtgatcaaaaaaggggataaaatccggagtttagttaacccttacccaaaattaaccattaaatatttaaattatttgctggcaacggaagcgactgtggagcttaaaactcaattagaacaagcaattgaatgtcctgttttggcggaggcttttaagcgttacttaaaaatgaaatggcgaaaaatcagttaaatatttggttaagtgagatattattaatcgacttatgtgaagaataaagaacgtgattaaatatttactgatataatggcgaaaatttttcagataattttaacaagcggtctctaattttgaatatttctttatttcgacaaattctctcctctacaaaatggcagaatgatatttttactttatctccgcaaaaacaagattggctattacatcaaggttcattaactcgaaaattacagcaatattgtcagcaactgaaagttgaaattgtggcggaaaaatgggtttctgacatgtcttttggatttaccggacatcatgagccaatttggttgcgtgaagtgatattaaaaggtgatgagcaagcttggatttttgcacaaactcgtttgccacaatctacgattgagaatgttgcacctgacattatcaatgtaggttcaacgcctattggcttatggcttttccctcaacaaccaaaaagaaaaacacttgaatggatatacgataccgcaacaggattatatgctcgtcgttcagtattgcttttaaatcaatatccaatcgaaattaaagaattgtttttgcaagattttaaattttttcaatcaaaggtctaaagcatgagaaccccgaaaaagacaaacaaaaaagcgaaaaaaatcaccgcacttacagaagatccgtattttttccaagagcaacagaaatattctaatccaatcccaagtcgagagtttattttacaaattattcgtgattttaatgcacctatgtcgaaagaaaatcttttcaagacattggctatcgttgattctgaacaaaaagagggaatgcgtcgccgtttgcgtgcaatggaaaatgaagggcaattggtctttactaaaagaaagtgttatgccttgcctgaaaaattggatttattaaaggggtcagtgattggtcatcgtgaaggctatggttttttacaaatcgaaggaagcaagtcagattggtttattccaaatattcaaatgcaaaaagttatccatggtgattttgtattggcacaacctaatggctatgaccgtaaaggacgttcagaggtgcgtattgttcgagtgttagaaagtcgcaataaacatattgttgggcgttttttcatggaggaggggattggttatgtcgtgccggatgatagccgtattaatcgtgacattctgattccgaatgagtttcgcaacggagcgagaatgggacaggtagttgtggttgaacttaaacctcgtacagcaacatttacgcagttggttggaaaaattgtagaaattcttggggagaatatggcaaagggaatggaaactgaaattgctattcgcaatcatgatattcctcatatttttccaagtgcggtagaaaaacaagtaagaaaatatacggatagtgtgccggaggaagcaaaacaaggacgaagagatttaagaaccttaccattggtaaccattgatggtgaagatgcacgagattttgatgatgcggttttttgtcaaagaagtggtgatggcgggtggacattatgggttgccattgccgacgtgagctattacgtacgtttgcgtactgcattagataacgaagcatatcagcgtggcaattcggtttactttcctaaccgagttgtaccaatgttgccggagattttatcgaatggattatgttcgcttaatccacaggttgatcgtttgtgtatggtatgtgagatacgaatttcgccacagggaaaaatgactgattacagtttttatgaagcggtcatgaactcatatgcaagattaacttacactaaagttgcacaaattttggcaggtgatgaattattacaacaacgctatcatgttttagtaccgcacttacaagaattgcaccaaatgtatcaggctctgctgcaagctcgttatcagcgtggagccattgattttgaaactattgaaactaagtttgtcttcaatgaaatgggacgtattgaatgtattgaacctgtggagcgtaacgatgcccataaaatcattgaagaatgtatgattttagcaaatattgcagcagctaattttatggaacgtcatcaagaacccgctttattccgtattcatgccggaccaagtcaagaaaaactcagtgcatttcgtgcttttctacgtgaatgtggcttaacgttaaaaggtggtataaaccccacaaccgcagattacgcacagttgttagcccaagttcgtgaacgtccggatcatgaattaattcaaactatgctacttcgttcacttagccaagctgtttatcaccctgataatattggacattttggtttagcactaacggaatatgcacattttacctcgcctattcgccgttatcctgatttaacgttacatcgtagtatcaaatatttattagcaaaacagcaaggttctaaaagaaaaacaaccgataccggcggttatcattattccctagaagaaatggatcttctcggtgatcattgttctttaaccgaacgccgagctgatgatgcaacaagagaagtggcagattggctaaaatgcgaatatatgcaagatcatgttggagatgaatttgacggtattatttcttctgtaaccggttttgggttgtttgttcgtttagatgatttatttattgatgggctagttcatatttcaaccttagataatgattattatcaatttgactcaataaaacaacgtttaattggggaaaattccggtacgacctatcgtctcggtgataaagttaaaatccgtgttgaggcagtcagtttagctcaacgccaagtggattttgttttattatcgagtcagcgtaaacctagacgttccggcaaaacggcgaataagcgagcgaaacaaaaaagcttccaagaaaagaaccgcacttctaagatcgagcgacataaaagtgcggtgaaaaaaacgaaaaacttatcaaaaaaacaacaaagtccggcaagtaaaacaagaaaacagaaaaaacagaaaggataaaaaatcatggcagaaaatatttatggaattcatgcggtgcaggcttttcttattaatgcaccagaacgtttgatcgaagtttatgtgctaaaagggcgggaagataagcggttacaatccgtactgaatgaactttataaattaggtataagcgtacaatttttgaatcgtgatacattggataaaaaagcgaacggagaagtacatcaaggtatcattgctcgtgttcaaccagctaaagagttgaatgaaaatgacttggttgagatcttacaaaaaaaagcaaatccattattgctggtactggatggtatcacagatccacataatttaggtgcttgtttacgatcagcagatgctgccggtgtttgtgctgtgattgtgccaaaagataaatcggcacaattgactgcgattgctcgtaaagtcgcttgtggagcggcggaagttgtacctcttgttcgtgtaacaaatttagcccgcactttacgagatctacagcaacaacataatatttgggttgtaggtacggctggcgaggcgattgaaactttatacgaagcgaaattaaccggcggtttagcacttgttatgggggctgagggagatggaatgcgtcgtttaacccgtgaaacttgcgatcaattgattagcattcctatggcgggttccgtctcttcattaaatgtttctgttgccacaggcgtttgtctatttgaaattgtgcgacaaagattagggtaatactttcttcatctaaaaaggttggatgtgatgtgaaatatgtttattatgtaaattaaaaggactgaaccctgcagaatacagagtgcagtccttgaattaaatcagtccaatcagatcatattgtcaggaaatttttgctattttatacccttcttatctagttttgcatacgtttgacagtcaatgtttaagccattatcgcacgctaatctataatattgtttagctttagaaacatttctttgtacaccctgtccgtwtkcrtacatcamrccgagattgtrttgtgcatttgcatmtccctgttcagccagttgtttgaataagggaaaagcgtcagaataattttgttgtttaataaattgtaaagcacgattaaatctttcggtatctgtttcggcaagtgtagattggacaataccgaaagagagtagggcgataagtagggatttttttagattcatctgagttcctttgctgactgcttctcatggttcgtttaaaaaattagatatttaagttaattgcatcatcaataaagtattggtccatatcaaatgcaggtttcgcccctttatttttgcctactatttgagaaggcacaccagcgacagtagtgtattctgaaacggattgtaacactacggagtttgcaccaattttagcgtaacgcccaatttcgatatttcctaacactttagctccggacccaatcatcacaccttctcgaattttaggatgacgatcgccgctttctttgcccgttccccctaaagttacaccttgcaaaatagatacatcattttcaatgacagatgtttctcctatcacaatacctgtggcatgatcgaacataatgccgcaaccgattcttgctgcgggatggatatctacatcaaaggcaacggatatttggttttgtaaatagatcgccaatgcttttcgtccttgttgccataaataatgggtaatacgataactttgcaatgcgtggaagcctttcaaataaagtaacggtgtagagtattgttctacggcaggatctcgatgacgcacggctcggatatcgcaagccgcactttcgataatttgcggttgattttgatgtgcttcttcaataatttctcgcaatgcaatagcgggcataattggattagctaatttgttcgcaagaatatagcttaatgcactgcctagattgttatgttttaagatagttgcatgaaagaaactggctagcattggttcattttcagcgagttttgctgcttcagcacgaataagactccatacttctattgacatgttactcccttttgcgttttcttcccaataaagtaatagctgcatcttcaggttttttaccacaaaatagtatttgatatacctgctcggtaatcggcatttctacaccctgttgctgggctaataaaaaggtttcttttgtattgtaaaaaccctctataaccggaccaagttcattgatagccgttgtacaatcaaaaccttgtcctaacattaatccaaaacgacggttacgagactggttatcggtacaagtaaggactaaatcccctaagccggatgttcccataaaggtatttggatttgcacctagagatatgcccaaacgactgatttcagcgattcctcgagtaattaatgctgtacgtgcattagcaccaaaccccataccatcagaaatccctgcagcaatagcaattacatttttaaccgcccctcctagttgtacaccaatcatatcttgattaatatagactcggaatttgctacaatgaattctttcttggaactctaaggcaaattgttcgttatttgaggctaatgtaatagctgtcggcataccggcagccaattctttagcaaaggtaggtcctgataagactgctaaaggataaccatatcctacatgctcttcaacaacttcttgtaataagcgtcctgtatttcgctccagtcctttcgttgcccaggcgatacgttgatccgatcttaagtgcggtttaatttgcatgataacgtcgccaaaaacatgacttggtacaacaattaataactctctggagtgttgaatggcttgtgctaaattgtcttctacatataaagaatcaggaaagtgaatattaggtaaaaatgcttgattttttcgctcattacgtaagcgttgacaatgttgaggatgatgtccccataagtaggttggataaccattgcgagaaaaggcaatagctaaggcagttccataagcaccggcaccaattacggtgattggagttggagaaggactgttatcattcatattttttcttagaattttcggagttaatagaaatattagggtgttattacaacaccctgagagattaatggacttctttcttttctttttcttcagcttttgactcctcttgtgcttgttgacgttgcatatactcaacaaataaggcatcaaaattgaccggtgctagatttaaagccgggaaagtgccacgattcactaaactggaaattaattctcgtgcataagggaataacatatttgggcattgagatgttaggcaatgtgctaattgtacatcttctaaaccgcttatagcaaagatgcctgcctgttttacttcacatataaaagcaacatcttcactgccttccattgtagtttcaacagagatattcaggcaaacttcataaagatcttctgctaaatgggttgtttctgtgcttaaattaaaatccagtttcggtttccattcctgttggaaaatgtgtggtagattaggtgcttcaaaagaaacatctttaacgtaaatacgttgaatttgtaaaacaacttctgttccttgttcttctgttactgcgtcttgatttttttctgtcatttttcgatccttatttatgttttttgactaaaggtaaatttgccgtaatccagccactgataccatctttcagtgagtaaactcgactaaatccttgtttaactaataattctgctgatgcacctgcattcatacctgttgcacaaactaaaattacaggggtatctttatgttgttcaatttttcctaaattttgatttttaatctctgttggcaatacattgatactgttgataatatgaccacgttgaaattcatctattgtgcgtaaatcaataacaatagcctcttcattattaattaaacgagtcgcttcggcgttttctactgccgtaactttactggtaaatgattttaccgatgtataaattaacatgacaaatacggcaatccatgctattaccattaggctatgattttttgcaaactctgttgctaaagggagatattcttgcattttttctatttttcagggttaaagttaaggttaaaaataaagggctaagtataaccgcactttcttcatctttcaaaatttttcaaagaaagtcttgcaaataaattgatctatattatagatagcttccctgtttattggtatattagccccaaatttcaaggaagtcttgataaatttgttgaaagagggtttccgattttatcggaaacgatttttaagtagaaaaaataggaaaaaaaatgttttatattcaattcgctatcgttttagtgtgtattctgattggtgcacgcattggtggtatcggtttgggcgttatgggtggtttagggctttgtattctcgccttcggcttcgggttaccacctgctggattaccgattgatgtgatgtttatgattatggctgtagtttctgccgctgctgcaatgcaggcagccggtggtttggattatatgatcaaaatcgcaaccaatattttacgcagaaatcctaaatatatcacttttgtcgcacctgccgtaacttggttatttactttcttagccggtactggccatgtagcttattctgtattaccagttatcgcagaagtaagtcgtcacagcggtattcgtcctgagcgtccactttcaatggcagtaattgcatcgcaatttgctattgtagcaagtcctatcgctgccgctgtagtggctgttgtgaactatttagaaccacaaggaatcaacttgggtagcgtcttaatggttactattccgtcaactattttaggcatagcacttgcttgtgtttttgtcaataaaatggggaaagaattaaaagacgatccgaattatcaacgtttattacaaaatcctgagtatgtcaaagaaaacagcgtaagtaatattgctgaaattgaaataaaaccgactgcgaaattatcagtgggcttattcttattcggtgcattacttgttgttgtgatgggagcgtatccggagttacgtccatcattcaacgataaacctatgggtatggctcacactattgagatcgttatgttaactgttggtgcattgattatcttaacctgtaaaccgaatggtaacgcaattacacaaggttccgtattccatgctggtatgcgtgcggtgattgcaatttttggtattgcttggttgggagatacattgatgcaaggtcatattgcaggcattaaagaaagtgtgaagttattagttgaaaccgcaccttgggcatttgcatttgcactgttcttactttctgttttggtaaacagtcaaggggcgactgtagcaactttatttccgctaggtattgcattaggtattgaacctgcgattttaatcggggtatttgtagcagtaaacggttatttctttattccaaactatggtccaattattgcttcaattgactttgatacaacaggcacaacaagaatcggtaagtttatctttaatcacagctttatgcttccaggtttattaagtatggcatttagcttaggtttcgggttattgtttgcaagtattttactttagctttcactaaataatttataaaaacaccgcacttgctttaagaagtgcggtgttttttgggattttgattttttaaataccgaataaaacagcaatgaaaacggtcaagccgaaataattgttatttaaaaaagcgttaaagcaactcgctctatctctatttttagtcaaacggcattggtaaacgaaaaataagccggcaatagccaatacaataaaatatctgttatttaattgtgataaataacccacggaaaagagaaaaatcagcgttattatttgtaataatgcgatgattttattgtcatattgagcaaataaaatcgccgttgatttcacgccaatacgcaaatcatcatcacgatctaccatggcatattgagtatcatatgcgactgtccaagataaatttgcaataaataataaccagcattctagaggcaatgcttcaatagtcgcaccataagccattggaatagaccagccaaaagccgcccctaagaaaaattgtggcaaatgtgtataacgtttcataaagggataaataaatgccaaaatgactgcaatcacagataaaccaatagtataaaggtttaaacaaaggactaataaaaaagaacaaaaaacgaggacgataaataaccattttgcttcacgaggtgttgctcgacctgttgaaagtgggcgtagtgaagttcgtttaacttttccgtcaatatggcgatctgcataatcattgatgacacaacctgctgaacgcattaaaaatacgccgcatataaaaattgctaaaactgatagggtaggcatcgctttttcggcaagatataatgcccaaagcgttggccaaagtaaaagcaatgtgccgataggtttgtctaaacgcattaattgtccataagcaatcaacttatcttttgcaaatattgtcatttgattggctaaaccttgtaattcttaataaaagtgcggtgtattttactgtaaaatcctttttggaaaaagtgagtttaccctataaagaaacagtgttatattgcgaaatacttttattgttaaactatcataaaatgactacattcaaagaaatcaactctgaacaagcatgggaaatattaaataataagaatgctgtattagtagacattcgtgatttatcccattttatttacagtcgtccgcaaagtgcttttcatttaactcatcagcgttttagtgaattccaacagaaatatgaatacgaccaaccgattattgtgagttgttatcatggtgtgagtagccgcaatgtggcacaatttttagttgagcaaggctatgatgaagtttatagcttaattggaggtttcgccggttgggtacaagcgaatttaccggtggaaagtggatattaaataaaaggcagacgattcctgccttagtttaatccaaccgcacaaacatagatcaaaacactataaaaaatcaccgtacttagtagcaaaacatattttgccagcttactgttacgttgatttaatttaaatgaataacgagcaataatgcctaaaataaaaggataagcccaaaagaaaattgacatccatctcatttgaaaatcatccaaatttggatttttaatgaaattaggtgagattaagagagctaatggccaaagcaaaacaggtaggcaaaacccaacgagtgcccaagaaaatctactaaatccggttggcatgttttgttttttcatttttatcctcgataatatatacaagagaacaggaatatagcaaatgaaactattatttggtagtgaaagagagaattttattatttggtttcgtgattatatccgagctaagtatttgcttgaattgaccattcaaaactatattgatgaaaaatataatcggtcggtgcgtggtgtttttatcgaagaaaatcatccattattgacacagcttgaacaagagaaaatactttttctgcaggatccttttaacccttgttatcagcaggcagcttgggaagccggcgatacacattccattcagtacaaaaaaacatcatgggtggctatttggaaaatctcatcgaaatggttccaacaaggtaaaataactttatttattaccgcactttgcactctaatttacgttttacagaacttgggatttgagcaaggtattttctattttgctcattatccagcaaatccggcacaacaaacagaaatttggcgttatatttcgcatagtttagtgcatctctcgccactacattttttatttaatctaagttggttttggttatttggcggggcaattgaacgacagctgaatgcaaaaaaattactgttgctcttttttgtttcatctattttgaccggagtcgtgcaaaattatttctctgattatcgtttcttcgggttatctggtgtagtttatgcggtattgggttatgtatttattttagataaatttcattatgctaaatttgctttaccatcaggttttttcttgatgttaattatggggatcgccttaggttttattagtccgcttgtaggtatttatatgggcaacagtgctcatattagtggtttattatgtgggatcttattaggcttatggcaagttaaaaaaagggcgttttgagaattaaacgtaacatattgaaatcaacgaaatgtgtattgtcttatttctatgctctttcaaactcaagataaaatagatcgaaatttggaggatagagataaacgctgtcttgaagagaaatttgttttgccattatggttattctgaattttcgcataaaatttgataatttcctttgactaattgacaatcaaaaggtaatattcacgccctatgcaaaaggtaaaactacccctaactgttgacccgattaaagatgcacagcgtagattggattatcaaggttgttatgtgtccaatcaagttactcgtttagcggagtcagtagtcaaagtgctcagcgatgtgcaggtaacattatcgtttttcgttgatccgcaaaaattgactgtaatgaaaggaagagcgagtgttgatgtggaattagaatgtcaacgttgtggttgtcctttcagtcaatcattggaatgtgagttttcttatagtccagtgtctgatttgggtaagatcaatgaattgccagagatttatgaaccgatagaattaaatgaattcggggaaatagatttaattggaacggttgaagatgaactgattgttgctcttccaattgttccgatgcattcatctgaacactgtgaagtgtccgtggctgaacaggtttttggcgaattgccggaagagctggcaaaaaaaccgaacccgttcgctgtattagctagtttaaagaaaaagtaaatttaggagtatagccaatggctgttcaacaaaataaaaaatctcgttcacgtcgtgatatgcgtcgttcacatgatgcgttaaccactgcagctgtatcggttgacaaaacaagcggagaaactcatttacgccaccatgtaaccgcagatggttattatcgtggtcgtaaagtgatcaataaataatcgttgattgtttaaggtaatcacttgagtcatctaactgttgtgttagatatgatgggcggggacatgagtccccgtattactatctgcgaattggtaaaagcgttgggtaagcatccaatgctgtctttgttgtttgctaataaccaacaaaattttcctctacgtcaacgttttccaatcgatagtcaaaattatttagccgtctgtcattgctctcatgtgattgaaaataatcagtgtttagttcataccttagttcatatttttgtagaataccagctaggtttattttatctatatgcagctttgttaaatataggtattgaggaaactaaagaatataaagaatataaagctattcgagatatggcattataatcttcaaagaaaggttaaagaaaatcttgccggtttgaataaaattaagacgtaacttgatgagataattatgtacagtagaattttagcaaccggtagttatataccggctaatatcaggactaatgctgatttagaaaaaatggtagagacatctgatgaatggattactactcgttccggtataaaagagcgtcgtatcgccggtgaaaatgaaacagttgccacaatgggatttgaggccgctaaaaatgcacttcagttagccaatatttgccctaacgatatcgatttggttttggttgcgactactagccactcctatgcttatccaagtgctgcatgccaaattcaaggtatgttggacattgatgatgcaatttctttcgatttggcggcagcttgcacggggtttatctatgctttaagtgttgcagatcaattcattaaaacaggtaaagtaaaaaaagctttagtgattggtgcagatattaattctcgtaagttagatgaaacggatcgtagcactgttattttatttggtgacggtgctggtgccgtgatcttggaaagcagcgatattgaagggattatttctactcatttacatgcttctttagataaaagtaacgccttaattcttcctcaaactcaacatggtgaagcacaatccggttatattcaaatgcaagggaatgcaacttttaaacttgcagtacgagaattatctaatgtagtagaagaaactttacgtgataatcacttagacaaagctgatttagattggttggtacctcatcaagcaaacttacgtattatcacggcaactgctgaaaaattgaatatgtctttagatcaagtggtaattactttagacaagtacggtaatacaagtgcggcgacagtgcctgtagcattggatgaagctgtacgtgacgggcgtattaagcgtggtcaattattattattagaagcatttggtggtggttggacttggggttctgcgttggttcgtttctaaattttaacaaaaattgaatatacttatttagtaggaaataaaaatgaaaaaatttgcaatggttttccctggacaaggctcacaagcagtgggaatgctggctgaattggctgcagaatatccgattgttgaagaaacttttcagcaagcttcctccgttttgggttatgatttatggcagttagtgcaacaaggtcctgcagaagaattgaataaaacgtggcaaacacaacccgcacttttagctgcttccgtggcaatttatcgtgtatggcaacaaaaatatcctcacctaaaacctgaagtgatggcaggacatagtttaggtgaatattccgctctagtatgtgccggtgtaattgatttccaagatggaattaagttggtacaacttcgtggtaagttaatgcaacaagcagttccggaaggaacaggtgccatgtacgcaattataggtttagataatgaaagcattgttcaagcttgcaaagcgtctgaacaaggtgagattgtgtcagcggtaaactttaattcaccgggacaagtggtgattgcaggagcaaaagtcgcagtagaacgtgctgctgttgcttgtaaagaggcgggagcaaaacgtgcgttgccgttagcagtcagcgtgccttctcactgtgcattaatgaaaccagcagcagaagaattggcagtagcgttagaaaaaatgacgtttagcatcccacaaattccggttattaataatgttgatgtgaaagcagaaaatgaaaccactaagattcgtaccgcacttgtgcgtcagctttatagtcctgtacgttggactgaaatagttgagaatatggcaagagagggaattgaacttttatttgagatgggacctaataaggtgctcactggattaactagtcgtattgttaaagagttgaatgctaaagcagtcaatgatttatcttcattgaatacagtggaagaaagcttagattaatttatgacaacagaggctgatactaaacagcctattttattgaggagtagatgatgcaaggaaaaatagcattagtaacaggtgctacacgtgggattggacgtgcaatagcagaagaattagcgagcaagggggcttttgttattggtactgcaacaagcgaaaaaggagcggaaagtatttctgcttatttaggcaaacagggtaaaggtttggtattaaatgtcgcagatcaagattcaatagatgctgtattgagtgccattaaagctgaagtgggtgatgttgagattctagtgaataatgcaggaattacccgtgatggtttattaatgcgtatgaaagatgatgactggtttgatattatgcaaactaatttaacgtctatctatcgtttatctaaagctgtattacgtccgatgatgaaaaaaggtggacgcattattaatattggttcagtagttggctcaatgggaaatcccggtcaaactaactattgtgcggcaaaagcgggtgttattggctttacaaaatcgttagcaaaagaagttgcagcaagaggagtaactgtgaatgttgtagctccaggtttcattgcaacagatatgacggatgtgttaactgacgagcaaaaagcaaatattctgacaaatgtgccgacaggtcgtttgggacagccaaaagatattgcgaaagctgttgcatttttggcatcggaggacgcgtcatatattacaggtactacattacatgttaacggtggaatgtatttaccttagtagaaagagggatttcaggctagccaaagataaggcgtaatgttaaaatcctgacatgtggtaatgtagctattgaaacaatcgagttacgttggctgttgcattctacaggttaacataacgtatttatgtttgtgtactgagacaggtatcattgtggtttgaccttgtaaaagtaaaaacagcttgaaacttcataaaaaatacatacactattatatcttatcgctaaccattaataggaaaaaagcaaaatgagcattgaagaacgtgtaaaaaaaatcattgttgaacaattaggtgttaaagaagatgatgttaagcctgaagcttcatttattgaagatttaggtgcagattctttggatacagttgaattagtaatggccttagaggaagaatttgatattgaaattccggatgaagaagctgagaaaattacaacagttcaatcagcaattgattatgttcaaaataatcaatagtaatgatacttgaaaattacacatgaaatcagtataatccgtattcacttatgaccctttgacagggtcatatttttgtgtggcacattgtgcttgtatgaaatggggagctgaaacggcgttattacccgcaaagaggaaattaaaaatggcaaaaaaagtccaagcatacgttaagttgcaagtcgcagcaggtatggctaacccatcaccacctgttggtccagcattaggtcaacaaggtgtgaacatcatggaattctgtaaagcatttaatgctcgtactgagagtctagagaaaggtttaccgattcctgtcgttattactgtttatgcagaccgctcttttacatttgtgactaaaactccgccggcagcggtattattgaaaaaagctgctggaattaaatctggttctagtaaacctaataaagataaagtaggtaaagtcactttagatcaaatccgtcaaattgctgaaactaaagcagccgatatgaccggtgcaacaattgaaactaaaatgaaatctattgaaggtacagcacgttcaatgggtttagtagtggagggttaatctaatggctaaacttactaagcgtatgaaagcaatcaaagccggtgttgattcaacaaaacaatatgaaatcaatgaagctattacggtgttgaaacaattcacttcaacaaaattcgttgaaagcgttgacgttgcagtcaatttaggtattgatgcacgtaaatcagatcaaaatgtacgtggtgcaaccgtgttaccacatggtacaggtcgttcagtacgtgttgctgtgtttactcaaggtgctaatgttgatgcggctaaagcagctggtgctgatttagtaggaatggaagatttagcagagcaaatcaaaaagggtgaaatgaactttgatgttgttattgcttcccctgatgcaatgcgtgttgttggtcaactaggtcaaattttagggcctagaggcttaatgccaaatcctaaagttggtaccgttacaccaaacgttgctgaagcggttaaaaatgctaagtccggtcaaatccgttaccgcaatgataaaaacggtattattcatactacaatcggtaaagcaaatttctctgctgaacaattaaaagaaaacttgcaagcattattagctgccttgactaaggcgaagcctgcgacagcaaaaggtatctttattagaaaagtaagtgtttctactactcaaggtgcgggcgttgctgttgatcaaagtagcttataattaatatagccaaacctttacagaggcgtattttgtatatataatgcacgcctctattttgccttatggcataatttctggttggtgcttgacctctcaagccccgtccaagaccgtaggggaaagaatatttcttaataatcctacgtagatggtgatacagaataagaatttttcttgcttctgtgcaccttagcctcagagaagactgcaaaagtgcggtgtttttttgagaagttttataattccgatcaatcggagtgtattcaggagctaaaagccaatggcattaaatcttcaagacaaacaagcaattgttgctgaagtaaatgaagcagccaaaggtgccctatcggcagttattgcggattctcgtggtgttactgttgataaaatgactgagttacgtaaagcagctcgtgaagctggcgtttctatgcgtgttgtacgtaatactttattacgtcgtgcagtagaaggcacagattttgagtgcttaacagatacgtttgtaggtccaacacttatcgcattttctaatgagcatccaggtgcggctgcacgtttgttcaaggattttgctaaagctaacgataagtttgaaattaaaggtgcagcctttgaaggtaagatccaaaatgttgagttcttagcaacattaccgacttacgaagaagcaattgcacgtttaatgggtactatgaaagaagcagcggcaggcaaacttgctcgcactcttgcggcataccgcgacaaattacaagaagcggcttaattaaagcctttcttaactcgtttaatttatttactttaggaattgattgttatgtcattaactaacgaacaaatcattgaagcgattgcttcaaaaactgtcactgaaatcgtagaattaatttctgcaatggaagaaaaatttggtgtttctgctgcggcagcagcggtagcagtagctgctggtccagctgaagtagctgaagaaaaaaccgaattcgatgtggttttagctgaagctggtgctaataaagtagctgtaattaaagcagtacgtggtgcgactggtttaggcttaaaagaagctaaagacctagtagaatctgctccggctaacttaaaagaaggtatttctaaagcagaagctgaagcacttaagaaagaattagaagaagctggtgcgaaagtagaaatcaaataattttgattttttcaatcttctagttcagaaaagacttggtggacaccccaaggtcagaataataatcctaccttttcgtgcgttttcgaaggtgggattattcttttttatgctgtcgaagagtttatttgtagatgatcgtaatttgggagaaaaactttacttttgtctgcagtgggttgagtgcggtttgttttaagccgcactttttcgtttcattcgcaatgagattttttattttaagaacgtttcataacttcaaaaaattcttcattggtttttgccatcattagcttatcaattaagaattccattgcctcaatttcacccattggattaagaattttacgtagaatccacattttttgtaattcatctggtgtagtcagaagatcttctttccttgtaccagaacgattgaagtcaatagcaggaaatacacgtttttctgcgattttacgggaaagatgcaactccatattcccagttcctttaaattcttcaaaaatcacttcgtccatttttgatccggtatccacaagtgcggtggcaataatggttaaactaccgccttcctcaacattacgggccgcaccaaagaagcgttttgggcgatgcaatgcattggcatctacacctcctgataagatttttccggaagccggtgttaccgtattataagcacgagctaagcgagttatgctatctaataaaataaccacatcttttttatgttcaacggaacgttttgctttttcaatcaccatttctgcaacttgaacatggcgtgctgccggttcatcaaaggttgaagcaatgacttcgccttttactgagcgttgcatttctgttacttcttccggacgttcatcaatcaacaatacaattaactcacattccggatagttatgaataatactttgtgcaatattttgtaacaacatggttttacctgcttttggcggagcgacaattaaaccacgttgtcctttaccgataggggaggctaaatctaaaatacgagcagtcaaatcttccgttgaaccatttccacgctccattctgaggcgtgaatttgcgtgtagtggagttaagttttcaaagagaattttactacgtgatacttctggtttatcgtcattgactcgatcaacttttagcaaggcaaagtaacgctctccttcttttggcggacgaatttttccttcaattttgtcgcccgtttgcaggttgaaacgacgaatctgacttggagaaacatatatgtcatcaggaccggctaagtaagaactatcggcagaacgtaagaaaccgaaaccatcaggtaaaatttctaatatacctcctccaaaaatgtcctctccacttttcgcatgttgttttaaaattgcaaaaataatgtcttgtttgcgtaaacgagctaaattttctaagcccatttgtttttcacctaattctacaagttcagaaacaggtttatttttaagttctgttaaatgcataataaataattgagaatgttataaaaatgaattgataaatgaattgaatgtaaatatgaaattgcgtgcaaatttatcattaaatctttaagttgtctagctatctaacttaaaaatcaataaatgtgcggacattttttgaggattttttccgttcatgttattatcacccaaattctttactgataatttttatgcaaaatagtcatctttcacaacaacgtttttctgatcttgctttacatcgtatcgtgcaacaagcgataaaagaaaaaggctttgagttttgtacacctattcaggcattgtctttacctatcaccttaaaagggcaagacatagctgggcaggctcaaaccggcacaggaaaaacgatcgcatttttaaccgctacatttcatcatttactacaaaaaaacaatataaattcctcagaacaaccgagagcgttaattttggcaccgactagagaattggttgtacaaattgcaaatgatgcgaattttctggttcaagcaacagggttgaaaacaggcttagcttatggtggtgagggctatgataaacaattaaaggtaattgatcagggtattgatattttaattggtactacagggcgtgtaattgattatgttaagcaaggaattattcgtttagattatattcaagtggtagtgttagatgaagcagatcgaatgtttgatttaggttttattagagatattcgttatttattacgtaaatgtccggtgcctcaacaacgtttaaccatgcttttttctgcaactttgtcttataaggttcgtgaacttgcttttgaacatatgaatgatccacagtatgtagaaattgaacccttacaaaaaacggggcatagaattagagaggagttattttacccttctaatcaagataaaatggcattgttgatgactttattagaagaagaatggccagagcgttgcattattttttctaatactaaacatcgttgtgaggaaatatggggatatttaagtgcggatggtcatcgagtaggattattgaccggtgatgtaatgcagaaaaaacgcttatctttactcaaacaatttacggatggaaccttagatgttttggtggcgacagatgtggcagcacgagggttacatattccggatgtgactcatgtgtttaattatgatttacctgatgattgtgaggattatgtacatcgtattggaagaacagggcgagcgggtgaaagcggtatttcaatcagttttgcttgtgaagaatatgcgattaatctgcctgcaattgaagaatatattggtcacagtattcctgtcagtcaatatgatgcgaaagcattgatcgaagatttgccaacacctcatcggattaaacgaggtgcatttgatagccgttcaaatttacaacgtactgtaaagagattgaaaaaaacttattaatttaaccgctcttttatgggatctttgccaagataagcaaatatccctttaattaccggacgataacgttgtacactaatacggaattttcgactaggaaaagagagataaaaatgacaccttatttaattgctccatctatactttctgctaatttagcacgtcttggtgaagatgtagaaaatgtgctaaagagcggtgctgatgtaattcattttgatgtgatggataatcattatgtaccaaatttaacctttgggcctgcgatttgtaaggcattgcgtgattatggaattaaagcacctattgatgtacatttaatggttaaaccggtagatcgtattattcctgattttgctaaagccggtgctgattatattacgtttcacccggaagccagtgaacatatcgatcgttctttgcaactgattcgggattgtggttgtaaggccggtcttgtttttaatccagcaacaccattgagttatttagattatgtattggataagattgatgtgattttgcttatgtctgtgaatcccggatttgggggacaagcttttattccaagcacattagaaaagttaaaacaggctcgtaaaattattgatgaaagtggcttggacattcgcttagaggtagacggtggagtaaaagtgaataatattgctgaaattgctcaagctggagccgatatgtttgtggcgggatctgcaatttttgatcagcctgattataaaaaagttattgatgaaatgcgtcagcaactttctacaataagagagaaggaaacaaaatgacacaatttaaattaattggttttgatttggacggtaccttagtaaacagtttgcctgatttagctttatcaattaactctgctttgaaagacgttaatttgccacaagcatcggaaaacttggtgatgacttggattggcaatggtgctgatgttctgagtcaacgtgcagtggattgggcttgtacacaagctgaaaaagagttaacggaagatgagtttaaatattttaaacgtcaatttggcttttattatggcgaaaatctttgtaatatcagtcgattatatccaaatgtgaaagaaaccttagaagcattaaaagcacaaggctacattttagcagtcgtgacgaataaaccaactaaacatgttcagcctattttaactgcttttgggatcgatcatttgtttagtgaaatgctggggggacaatctttaccggaaattaagcctcatccggcacctttctattatttatgtggcaagtttggtctgtatccgaaacaaattctttttgttggcgattcgcaaaatgatatttttgctgctcattctgcaggttgtgctgtggttgggttaacttatggttataactataatattccaattgcacaatcaaaacctgattggatctttgatgattttgctgatattttaaaaattacacaataaggataaaaaatgacaaaaccggttgtattaagtggtgttcagccctcaggtgaattaactattggtaactatttgggtgcgttgcgtcaatgggtaaacatgcaagatgagtatgagtgtttatattgtattgtagatttacatgcaattacagttcgccaagatccggacactttacgtaaagcaacgttagatgtattggctctttatttagcctgtggtattgatccggagaaaagtacgatttttattcaatctcatatacctgaacatacccaattggcatggattttaaattgctacacttactttggtgaaatgagccgaatgactcaatttaaggataaatcggcacgtcatgctgacaatatcaatgtaggtttatttacctatcctgttttaatggcggcagatattttactttatcaagcaaatcaagtacctgttggtgaagatcaacgtcaacatttagaaattacacgtgatattgcacaacgttttaatgctctttatggggaacattttattgtgccagaagcatttattccaaaagcaggtgcacgagtaatgtccttgttggaacctgagaagaaaatgtctaaatcggatgaaaatcgtaataatgtcattggtttgttagaagatcccaaagcagttgtgaagaaaattaagcgagctgtaacagactcagatgaaccgcctgttgtgcgttatgatgtaaaaaataaagcaggtgtatctaatttattagatattttatccggtgtaacaggaaaatctattgtccaattggaagctgaatttgaagggaaaatgtacggacacttgaaaagtgcggtggcagatgaggttgctactatgctgactacattacaagaacgtttctatcatttccgtaacaatgaagaattattaaataaaattgcggctgaaggtgcagaaaaagcccgtaagcgtgcaaaggaaaccttagataaagtttatcgtgcaatgggttttgttactccataaaaacgatttttcccctaagtatttaggggatctttattcttattgtaatacattttcgaaaaaaacagtatttgcagtagggtcacttaatgaaaatagtaagaactttccgaaaaaccgctgttattacaaacctcagaaatctgatacttcgtatagaataagagaaaaatcttctatggcaaaaaatagaaaagcaagcatttcccatgtgacattattagggtgttaaaatccaaggttgtgctaatgaaagagaataaatattagcgatgaaatgagattgttcttctttgggaacggggaagggaataaaggttaatagttcttggtgtaatttcaaaatttttgtaaaacagaccgctctttcgatctctgaaaaaaaatctgggtttaatgctttagccacatatcctctttttattctgcctagtgccatagctaaatgaatgagtaacatgtctacttgtttcgtttttaaatttactcgccattttttaccaagacgatttcggatattaagagtaattgtcataatatcttcatcaattaaatggcgttgaactaaaaaaatcagcctttgctgtattaacatgaatttcattccattacgaaaaggatagtttactttacctgaaataaacacaattaagtagtgcatagatcacaactttgtaggaaaataaacaaaattttacacgataggaattaagatgttaaacaaggaaattatcgcacgatatgaaggattaatttttgatatggatggcacagtaattgatactatgccttgtcataaacaagcttgggagcttgttggtgctgaaatgggctatgctttggatggagatgttatgtatcaattggggggagctccggtaagaactattgccaaagccataatggaaaaagcacaaatgccgttatatttaatggaagatgtgattagtttaaagcgtaaatatggaattgaattaatcatgaaaaatgctactttattgcctgctgcggatattgtgaaacaatatgttggacaaaagcctttagctctcggtacaggttcacatcgttacgtcacggaaatgcttttagagaaatttcaattgcagtcttattttggtgctattgtgacagcggaagacgtgattaatcacaaacctgagccggatacatttttgcgttgtgcagaattattaaatcttgatccgttaaaatgccttgtatttgaagatgcggatttgggcgtacaagccggattagcggcggaaatggatgtttttgacgttcgtgtaaatcaaataattacaagcaagtgattagattttatctgtattttgtgtaatctaaacatttaggcagagtagagaaatagttgccaaccttatttttgattatgtttgtagcttttatttaaaaaatactttataaacataaagttgtgcttttttaatccgttatgattatttcacgtttgctttaactctttaaaaagacccttggttctatttattgtcctttcaatatctaactcagaatatttctcgaaagtaaatagataattgtgatattgctttaaactagtataagctacttttattggcaaaacagttgtttattcatttttcaaaaataaagcttaaagccttgtgctataaggctttaagctggtttttagacaactattttgtctgctttagaatttataatttacatttaaaacaaatgtgcgtccttttgaatagttgtttaaggctttctggtatccatcgcccacgcccatagcataagtcatttggtttgccgagtcgttattcgcatctagcggattaatgtattttttatcaaaggcgttttgaatttcgcctttaatagttaagttttccgttggttggtagatagcgtaaaaatcgaaaattattggctgtgctttgatttcttccgtgccgctaattcttacataagtaagaaatgtctcgccagtctttctagaagtaaaagttcccggcaagataacatcgccatctgctttatcaagtctggctcgtttgcttttaccatagtatttagcagtaccgcctaatgttaattttccgtcaaataaacgtgttcctaggtcaagggaaccgtaatctttcggtagagacgatattttacttaagccgaacccttgtaaatattgtccggtttcactatcgtcccccacgctattactggaatcagaatatgaacttggctgattggttttttgtctggcataagataagttggcatagaaccaaccgatatcataatttaattcaagttccaatccctgaattttaacaataggtgatgaatcagcaggaatgagttggtttaaaggaacttttgtttttccatctcctgagtctaccatttctgttttcaagattgttttgccaccttcatagttaatatgcgtaagatgcccaacgcagtcataaatagtcggtgctttatctgctcctctccaagcgtttgaactacattcttgtttgatattgataatataatctctgattttcgtttgatacgccaaaaccttaaagcctagtgcatcaaaatccgagaatatcccatttttataaccgttaatgccgaattgaatggttttggctttttctgattttaaatcgggtcttatggctaatgtaccaaattcggagaaatacatctctttgatattcgggacccgatgggttttggcataacttacaaatggcgaaaagagcgggtgaaaatccgcagagaaagacatagaatagttatcatgtgctcttgaattccccttttggacagagtagaaagtcgggcagttataaacatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctatctctaggatcacgagggaaagttgcaccgctatatttatagatttggcgattggcattgacttttaaggtataaatatcgtatttaaaggtttggtcaaaatagagggttttaaaacgttgttcgccgtcgggttggaacgtattcgatcttataccgtgatatatacatgcgtttttatacttaccaacgtaatcacagaaatcacgtgaattaggttctccgccgtcaaaataataacctaattcacgaggatgtcgatttttactgtatttatttttgaggatattggcacctaatgttgcttcataagagaatttttctgtgaatggaatagaaaaatgcatatttatatccgtggttttcgcactatttttgctttccaacacatctttcagcattttaccattaaacacgcttcccttgtgataggtttgcgtagaggtattatccgccaagattaattcaaattgtaaattctctttcggttttagttggtagtttaactggtagtttttattctctaaatttctgcctgaaagtgcggtcgataaagagcggtatgataggatagctttattatatttatcgttatattcgattttggctaaatggctttggggatagtggagtaatttgcttgggtcatagggttgtaatccatagagttttcgtttttcatttctgtcacaaaaaggctcacctttacaagcttctttaactattcttcccacttcttcagcgtcaacatcttttatacttctacccccccccactttaaaatcttgcgagcttttacgccaactataggcatacataaaacctaatgttcttgtatcggaaaaaggatagcgaaaggcaactgcacccatataattcggtccggttgcattggttcctccgccaacatttaataaagcacccacatttctgccttcacttatcacatcatcaacaccgattgttctaaaatttgccgaacctactagagcattagcccccgctttaccgtcaaaacttcctcgttgaatatctacactggtaataaacgcagggtcaatggttgcaccgaattgagaggttccaccggctttttcgctgttatctcctgatgtggcaaaaaaggtttgcgaaataccgtctaccatcgtattcacccgtccaaatcctgtttgaccacgaacgttcaccgacactgtccccgaacttttatcaaggttggtaaacgcacccggtaccgttctgatgatgtcatcaatggattgcgttgacgtggaaatattttctctcacactggttgcccccgcttttttaaagacttcctgtttaggtggcagtttatattctacattaatttgatcgagcatttcttccgcataaacacaagtgcttaatacggaaaacgctaccgcagtgagtttaaatttattagtcatcatttttatcctagttatttatgattaaattcatggtgtaaacatgtacgaccagttatataaaaatatcctgtgtatgtcaattaatgataataatttttattattatttttagtttatatggaaattcagcatgttatcaaaattgatattcgccagcctgaaagccagagtttggctctggcggaaaacatgctttagttaaaaatgattcggaggaaatgcggtctattttttacaaagatttatttttaataaaaggaaactgaatgcgatattttatcgccagcattctgatgagtgtacaggttataattgccagccatggacttagcaaaggggaaattaaaccggttgaacccaataattctattgtcgcaccgacaattgccgcactggcatatatttcagactgaaaaattaacggcggttttgccgtcaatatgtctcggatacaaccaccgcccactgcactgatacagcccaaaataatggataattgaatattttccgttagataccatgttttatttgcaccgaaagctgcaaaaaaacctaatccaacggcatcaagtaagttgctcacctttgagaacgacgttattttttcttgaaaaaaagatacgcaacacacggctaaaaggataattaatagataggcgatattttccaagcctgccggcggtgttgctgataggcataaatctcgaataattccaccgcctatcgctgttactgctgagacaacaaaaacaccgaataaatcaaattgttttttcacccctgcaaccgcaccacttaaggcaaagataaatgtaccgagaagatcaatgaaattaaatacggataacataaaataccttaatcttaattttaaggcatcattatagcataacgaaattaaaaaaaaacttcgcagatgtaatggacacaaaaggattctatacattaatgaagcaaagtgtacatttgtacattacatcagcatagttgttatggtaatctagaagaacaaagtgtgttgaaaaaagagattcttggcgtaatgccgattttaatatttaaacgaaatatcctaagttatggtgaagaatatgataagtaatttaaccgaacagccttctggtgctgagtaccttaaagcaattttaagttcaaaaatttacgaacttgcacaggttacacccttacaacctatgctcaaactttctgagcgtttaagtaataccgttttagttaaacgtgaagatcgccaattagttcatagctttaaattgcgtggtgcttatgccatgattgccggtcttagccaaccgcaaaaaaatgccggtgtgattaccgcttccgcaggaaatcatgctcaaggtgtcgcactgtcagcgaaaaatctgggattaaacgcattgattgttatgccgcaaaataccccccgcattaaagtagatgcagtgcgtggttatggtggcgaagtgcttttatatggtgcaaactttgatgaggcaaaagcaaaagcgatagagctttctgaaagtaaaagtatgacatttattccgccttttgatcaccctgcagttattgcaggtcaaggttctttagccatggaattattgcagcaaaacagtcatattgatcgtatttttgttcctgttggcggtggcggattagcagctggcgtggctgttttaattaaacaattaatgcctgacattaaagtgattgcggtagaaagtaaagattcagcttgtttacacgccgctttgaaagttggtcaaccggtagatttagagcgtgtcgggttgtttgctgacggtgtggcggtaaaacgtatcggtaatgaaactttccgtgtatgtcaacaatatattgatgatgttgtacttgttgatagtgatgaagtgtgtgcggcaatgaaagatatgtttgaaaatgtgcgtgctattgcagagccatccggtgccgtatcattagccggcttaaaaaaatatgtgaaagaacataatattcaaggtgaaacgttggttaatattttgtccggtgcaaatttaaattttcatacattgcgttatgtgtcagaacgctgtgaaatcggtgaaaaacacgaagcaatttttgctgtaactatccctgaagaaaaaggtagtttcctacgtttttgtcatctgttaggtgatcgccctgttaccgaatttaactaccgttatgccgataaagaacaagcctgtatttttgttggtgttcgtattagtagtgaaaaagaaaaattagaaattattcaacaacttgaacaaaatgattataaagttatggatctctctgatgatgaaatagcgaaaacccatattcgctatatgattggaggacgaacaaccagcaatagcaaagagcggttatataatttcgagtttcctgagcaaaaaggtgcgttgttaaaattcttgatgatgttaggtacgcattggaatatttcccttttccattatcgtgcttatggtgcagactatggtaacgttttggcaggctttcagttagatgagcatgatgaaattcgtttcaacggtcatttaaaagaacttgcttatacttatcaagatgtaacggacagtcctgcttacaaatatttcttagcttgannnnngatgaaatcaaaaaatgccatactaaatggcattttttctactcaactttgttaattcgcaactctttcggcacttcaaaaacggtattttcttcgcaaccttcaagctcatccacttcatcaacacctaattcttttaaacgggaaatcaccgattgaaccaatatttccggagctgaagcaccggctgttaagccaataactttcacattatttaaccaactcacctcaatatcatttgcatcatcaattaattttgcagtaactcccattcttgaagcaagttcagctaatctattggaatttgatgagtttttagaaccgaccacaataactaaatcggacaattcggctaattcacgaacggcttgttgtcgattagttgttgcatagcaaatatcatttttgcgaggaccttgaatggccggatatttttgttttagtacctcaatgacatcggcagtatcatcaattgataatgtggtttgtgtcataaacgtgatgtcttcatcattccgtaaagtcagtttggcaatatcttccacatcttctactaaataaataccgcccttatcgttatcatattgtcccattgtgccaataacttcggggtgtccttcatgcccaatgagaatggcttttgttcctttacggctggcacgagcaacttgcatatgcacctttgtcactaaaggacaagtggcatcaaatacttttaaattccgctctttagcctcttgacgaacagcttgcgaaacgccatgtgcagaaaaaattacaatagcaccattaggcacttcgtctaattcttctacaaaaattgccccacgatcacgcaatccatccacaacaaaacgattatgtacaacctcatgacgcacataaataggtgctccgtgaatttctaatgccagctccacaatactaatagctcgatcaacaccggcacaaaaaccacgaggattagccaaaatgattttcattagttctgcctgctctcttttttatcgttttgcttaaaagcatcaatagccaataatccggcaccaatacaaattgcaacatcagcgatattaaatacggggtaatgccattgtttccaataaaaatcaaaaaaatctaccacaaagccatgataagctctatcggctgcgtttgccaaagctccaccaaccattaacgcatagcctgtattttgtagtttctgtgttgcttgatttttatataagaaaaataaaatcatgaaggaaacgactaaagccaataaaataaaaaagtatttttgccaacctgcatggtcagccaaaaagctaaaggctgccccgtgattacgcacgtaagttaaattaaagaaaggcaatatattaatactttcgtataaagaaaaattttttactacagcgagttttgttattaaatcagtaaaaaaagcaaccgcacttatccaaagaaatggaagtcctgtttttgataaattcatatggtttccaatagatgaaaaacgggcgtaatataacacccaatttaaattatcttgcgattaaacgctcgtgcgttctgtttcgcaggatctactttgatagccgttattgtaaaatcttaaacatctctctaacggcagaaggattatatcttactttataccttatatccacgctctgaaagacggagatttacggcacgttgcgataaaattaaattctatgtgagtttagttcgattattctgttgtattttaaccgctcttttccagcaaaattgaataaattagaggataaaatttatttacttatattgccattgtttggaattttctctagaatttgagaaattttaaccccaaaacagataggtaatacaaaaatgaagaaaaaaatcacttttactaaatctctcatcgcttcagcgttggcattatcagcgagttatgtcaatgcgtctgctttccaactcgccgaggtatccagttccggtttggggcgtgcttatgcaggtgaagcggcaattgctgataatgccgccgttgtagcaaccaaccctgcattaatgagtttgtttaaagcgaaacaattctcatggggggggggtatacgttgattccaacattaatgtaaacggaaaaatagacgttagcacatcaccaattccttcttctcctgatattctaaatgttaaagccaatcaaaaaaatatcgtcccgaatacccttattcccaatctgtattttgtaacccctattaatgataaatttgccatcggtgcaggcatgaatatgaactttagtttgagaagtaaatataaagatgattatgttggcggtgttttgggtggaacaagcgagatggattctattaatttgaatttaagcggttcatatcgtgtcagcaaaggattaagcgttggtgcaggattaaatgccatttatgccaaagcgaaatttgaacgccgtgcagggattttaaagaaaactattgatagtttacgtagtgatgacaatgagctgcttattttactctctccatcaatagtatcatcggcatatagcctaacatttcatgaaaacagtactgtagcacgcttacaagataacaatgcatggggattgggttggaatatcggtgcggtttatgaatttaatcaagataatcgtatcggtattgcctaccattctaaagtagatattgattttaaagataatgatacattgggttatatacttggcaaagaagagattaagcttcatcgtgcaaaaggtaagttaactttacatttaccgagctatttcgaaatttccggtttccaccaattaacagcaaaatttgctatgcactacagctataaatatacgcaatggagccgtttacaaagtttgcatgccgcttattccaatggtgaagtcgcttttcataaagatgaaaactttcatgacagttctcgtgtagctttaggggcaacttatgatgtgaatgataaattaactttacgtgcaggtattgcttatgatgaatccgccgaccacccaactgcttccattccggataccgaccgcacttggtacagcttaggggcaacctatcatttcacaccaaatctttctgtcgacatgggctttgctcatttacgcggtaaaaaacagaaatttaaagagaaccactcatttacaagcaaagataattatgaagtaggtagaatagatgcagattatcaatcaacagcacgagccaatctgtatggcttaaatcttaactaccgtttctaacgattatccaattgtttattagttatagaaggcgtattttgatacgcctttttattttttactcaaaacatcataaaatcttaaatgagtaatctaataaatatgtcaagttgcgattttaggaaaatgtcagtattcaatatcaatcaggcaaattgacgttgctctccgttaccttctacgttttcgatacaacgcccgcaaatgtgagaatgttccttatttgatccgatgtctgtagaaaagtgccagcaacgagggcatttttccccatcggcacgttccacttttatcgctaagcctgtcaattcgctttcagctacatcggctttcgacaacggtttcactacgacttgtgaggtaatcaacacaaagcgtaactcattaccgagttgttccagtaatggacgaatttcctcgcttgcatagacggtgactttagcttcaagtcctgctccaattaatttgtcgttacgtgcttgttctaatacacggttcacttcggcacgtacttttaataactgttgccagtaagtatcgtccaatttatcgctttcatctagcccaaacaaaccatcataaaattcctcggtaaagacgaattcagcacgattatccagttttggcaagtagccccaaatttcatcagcagtaaaagataaaatcggtgcaatccaacgcacaagagcttctgaaatatgccataatgccgtttggcaactgcgacgagcaaggctatccgccttagttgtatactggcgatctttgataatatccaaataaaatgatcccatctcaattgaacaaaaacgcattaagcgttgtacaactgtgtggaattgatagttatcataagcttctttgatttcgttttgtgcttctaaagcacaacttactgcccagcgatcaagagaaatcatttcttcagggttaactaggtcgttttttggatcaaatccgtttagatttgctagtaaaaaacgagcagtgttacggatacggcggtaagtgtcgcctgcactgtttaagattttgtgtgaaacggcaatttctcctgtgtaatcagtggacgctacccataaacgtaaaatatccgccccgtttttgttccaaacttcacttggcacaataacattaccgagagatttggacattttccgacctttttcatccaccgtaaaaccatgggtaagtacttgcttataaggtgccttattgttagttgcagtagataacatcaacgaagacataaaccagccacgatgttggtctgacccttctaaatacatatccgtagatttaccgttaaattcagggcgttgctctaccacggaagcataagttgatcccgagtcaaaccacacgtcaagcgtatccggcactttatgataagtttttgcctcttcacccagtaattccgcaggatcgagatcccaccaagcttgaatacctgctttttcaacacgttttgctatgtcttcaagtaattctaacgtgcgagggtgtaactcttccgtttcattatgtacgaacatagtcatcggtaccccccaagtacgttggcgagaaatacaccagtccggacggtttgctaccattttatcaatgcgagcttccccccaacttggaatccaacgcacagatttaatttcgcttaatgcttttatacgcaaatcttgcgtttccataccgataaaccattgtggtgtagcccggaaaataatgggtgttttgtgtcgccagcagtgtggatagctatgtttaatacgttccaatttaagcaatgcacccgtttctttcaatttttccaataccaaatcattggcttcaaatacgcctttaccggcaaagaatggcgttgaagaaatgaatttaccgtcatttgccaccaacccagccatttccaaaccatatttttttgataccacaaagtcatcttgaccgtgatccggagcggtatgaactaaacctgtacccccatcaacggtaacgtgatcgcctagaatcatagggacagaaaaatcgtagaatgggtgattaaagcggataagttctaaatcgccaccttttgccgaacctaaaatttgtatctgctcaattcctaacgcattttgtaccgtttgcactaattctgtcgccaagatgacacgctcgttaccaagttgaacaagctgatattccaattctgcattcactgcaatcgcacggttagacggtaatgtccaaggtgttgtcgtccaaatgatcgcagacaatgctccttgacctttaccaagtgcattgaatttttcttcaacctccgccgcacttaccgccgcaaaacgcacatagattgatggcgaaactttgtcttcatattccacttccgcttcagccagtgatgaagcacaatctaagcaccaatgaacaggttttgaacctttgtaaaggtgaccattttgaatcactttacctaaagtgcggataatttctgcttcagtttcaaaattcattgtaagataaggattatcccaatctcccagtacgcccatacggataaagtccgctttttgaccttcaacttgttcttttgcataatcacgacaagcctgacgaaactctgctgctgaaattttctcgttcggcttacctaccaaaccttctacttttaactcaatcggtaaaccatgacaatcccaacccggcacataaggtgtatcaaagccaagtgcggtcttagatttcataataatgtctttcaaaattttattgacggcatgaccaaggtgaagtgtaccgtttgcataaggaggtccgtcgtgcaaaataaaggttttcttacctttagaggcttctcgcactttttggtataaatttttatcataccagttcttcaacatatctggctcacgtttagccagatcacctcgcattggaaaacccgtttcagggagatttagagtgtttttgtagtctgtcatattaattatttctcaactttataatgaatccaagattgttttcgcactggaatacacaaggataacccattgatttaccgaatttaccaaacgaatttgtccattcagaaattcaaccatccaataatcatcaaaattaatatctgtagtattaatattgcattcttcatttgaccgagcataatctgcaccgcatactacttttgtcggcggaccatacttttggggcaatccatttaaaatatctttcacttcttgtacttcacgtgggaagggcggtctgttttggctataattcaaaatgtcaattgcaatactgttcaatacttgtccattaaaataagcggttgcctctcgattattgccgttaaataaaaaatgctgacatttataagaatttaatggctggtaatattcccaaccggtgcataatttagagtcggcaatttgttgataggtcatgccgaatttaagatctttataaccgtctaaaatgatattttgggcaaaactcaagcagggaataaatgtacccgaaatcagcaacaaattttttaactttttcatgaaatgtcctaacagaatttcttgcattaacataatttatttgcaacaagaaaataagcaaaagcgatttagcattatacgcataaatccttaacggtcaaaggttcaagacttgctgaaaatacttttttgccacaacaacatcattttcaatctgatttttaagggcatttagagaaggaaattttttttcatggcgaattttatggcaaaattcaatttgcaaggattgaccatacaaatcacgatcaaagttaaacaaatgcacttccaataattgttttacgccattgatagtaggtcgcttgccaatgttggcaactccttgaaaaatatcgccattttttaaccgcacttttacaacgtatacacctttaattggattaacttgccgatgtaaataaatgtttgcagtgggaaaaccaatagttcgtcctaatttattgccatgagcaactcgtccataaatacgatatggcttacccagtaacttttctgccaacgctaaattatcttctgataaggcttggcgaatggcggtgctactaatacgctggtcatttaattgtaaacttcgattatcttccactataaagctttgttgttgcccttttttttgcagaagtcgaaagtcgccttctcgatttaaaccaaaccgaaagtcatcaccaatgcttaaaaacttcatcttcagatgtttcactaaacaatctgaaataaattgctccgcacttaattgggcaaaagtgcggttgaatttaacgcagaaaacataatctacacctaactgtgccaaataggcgagtttatctcgtaaacgcataagccttgccggtgcctgatcaccttgaaaatactcataaggttgaggttcaaataacatcactacaacgggcaaattcagttgttttgctttcgcttttaaatgttgcaaaatagattgatgccctaaatgaacaccatcaaaattaccaatagttacagcacaaccctgctgttttaaaggctcgggtaaattatgaaaaccacgaataagttgcataacatcgcctaaaaataaaaatttcttgaaaattgtcgcacattatacgtataaatatacaatggtaaaagaatgcagcataagcttactttctgtttaaaattagaaaacgacaagcataaggatttttctcatctgccggacgttgttgctcaaattcaatctgccattcttgccaattaaattcaggaaagaaagtatctccctcaagttctgtttgaatttccgttaaatataatttatttgcttgaggaaggtattgcttaaataattcgcccccgccaatcaacataatttcatgatgattttctcgcacaaaatctaccgcactttgtagattgtctttccaaataatgccatcgtgttcataaggcgaacgagaaagtacaatattggttctattcggtaagggacgaccgatactttcaaaggtttttcgccccataatgatgggttttccgccagtattttgacgaaaccaagcaagatcagccggcaaatgccaaggcatttgattatttttgccaatcacatgattttttgtcatagcaacaattatacttagtttcatttactttccttcttccttatcaaaaatcaaaaaagtttatcagcgagagtgactatactacaggtttgtgtcgataaaacaataagccgggtaatgctaggccaaaaacaagtgctccaatgaggaaacctgttttgagaaaatattccgtcatttgtgctatacgttgttcattgaaaccataatgatgcaaatgaacaattgcgatcatggctttataagcgaaaacgcctgggatcattggaataaccgctgcgacagtaaaaactttcgggtgagccaaataacgatgcgataaatatacgccaataaacccaaccacactggcagctataaaagtcgcaaaaactaaaggaatatcgaaatgtactaagaaagttcttgtcccatgccccaatgcccccaaaaatgcacaatattttaaaacattcttaggtacattaaacactaaagcaaatccgacggcaggaatagctgcaaaaaacatatcatctaataactttaagataaggtccatgattaacgcccccaatcggcaatatgtaaaaaacttagtgcaaatacaattcctaaacaagtaccaaaagttaatactgttgccaaagtccaacgtgcaattcccatattaatatgtccttttagaatatcggcaagcgaattaatcaatggaaaccccggtaccaataacaatacacttgatgctaaggctatttgcggatcattacctaattcatatttaacagccaaacccgccaccatagaggcaacaaaagcggttatagcaaaaacaatcaaaggattataatgacgcaaagttaaagtttgacgaataaacatagcgatagatgaggcgataaatgtgattaaaaaaacgattatatctccaccagataaatgggcaaagcaagcacaggacaatccgatcatagtaacaactacaaaacgattgtattttaaaggcttaataccatctaattttttgcgaatctgttgcagatcatatagtcctttttctgccataattaccaagcgttgtacctctgttaccacttgcatattaatgcctttatcaaggtttttgcgtaccgtagtaatgcaattgtgatcatataatgtagtaataatgacggcattgggtgtcagtgcacattccacactatctattcccaatgcaaaacctaaacgttgtgccatttgtacaatcaatgtactttctgcaccatgctgtaataacatctgtgcaacttgtgcacaagttcttgttatttctcgttgtcgaaatgagctattatcctctgtagtattcataaaaacacctcattctattaaaaaagatgaccgcacttattatatgcttttcttctgtatcaattttgttttaaatcataaaacagcaatgaaaatcgcatgatttttcctaactttaatggtaacttatggggaaatttttcaagtaaagacaactatggaaacacaaaaaacaaataaaaccattgtggtaaaatttggtaccagcaccttaacgcaaggttcatcaaaattaaatcgccctcacatgatggaaattgtgcgtcaaatcacacagttgcatcgagcaggctttcgtataattattgttacctccggagcgatggcagcggggcgacattatctcaatcatccgcaacttcctccagcaattgcctcaaagcaattactagcagcagtaggacaaagtcaactcattcaaacgtgggaacaacttttcgctatttatgatattcatattgggcaaattctgttaactcgagcggacattgaagatcgtgaacgttttatgaacgcaagagatacgttacatgctttattagataaccgaattattccggtaatcaatgaaaatgatgcggttgcaaccgctgaaattaaagtgggggataatgacaacctttctgcattagtggctattttggcacaagcggaacaactctacttgctaacagatcaacgtggattatttgatagtgatccaagaaaaaatcctcaagcaaaactgatttccatagtcgataaaattactgatcatatccgctctattgcaggaggaagtgggacaacgttagggacgggaggaatgacaacaaaaattagtgctgctgacatagcgactcgttccggtgttgaaaccattattgcaccgggtaatcttgaaaatgtcatcgtcaatttggcttatggaaaagaaatcggcacaaaatttgttgtgcagacagattgcttggaaagccgtaaacagtggctctttgctgcaccggttgcaggtatagtaactattgatgagggagcggaaagtgcggtattgattcagcataaatctctattacctgcaggtattatcagcgttgaaggatgtttttctcgtggtgaagttgttaaaatttgtggcacgaacggtaaaaaaattgctttgggcgtacctcgctataacagcgattctctcatacaaataaaaggaaaaaaatcgcaagacattgaacagatcctcggttatgaatatggttctgttgctattcatcgtgatgatatggtcgtttattaatcagaaagtttttatcctgataaaataacaaccagcttgtcaaaagaatgtgtttagactactaaatgaagagcaaagacttcatatactcttgaagtcatatatgaataaaaacccggcaaatgccggggttggaaaagagatataaagttaaaagaacttaaccgtttgctttctcaacttgactgaattcgaattcaaccggagttgctcgaccaaagattaaaacagaaactttaagacgccctttgtcgtagtccacttcttcaaccgtaccattgaaatcggcaaacggtccttcagtaacacgaatttcttcaccgggttgaaactctttgcggtgacgaggcttatctgcagtttcttgtacacgattaagaatacgctcggcttctttttgtgaaataggtgccggtttatctggtgttccaccgataaatcccatcactcgtggaacactgcggactaactgccaagtatagtcattcatttccatttgaactaaaacataacctgggaaatatttacgctcacttttacgacgtttaccaccaacattttcaactacttcttctgttggaactaatacttcaccaaactgttcttccatttgatgtaatttaatatattctcgtaatgtcgcagcaacacgaccttcaaaaccggaaaatgcttgaaggacataccagcgttttttggctgtattttctgtcatattagaaccttaaatccgttaaaaatgtaattaatgaaacgataactgaatccaatccccataaaattaatgatgctattacagtcacagcaaatacaattaatgttgtttgcattgcctcagggcgagtaggccatgtgattcgtctcagctcaatacgagaatcggaaaaaaatcttctggctttcataccttgattagtaatagcggcgatacctaaagcaataagtaaagcaacaacaatacccacaacacgaagagctgttgaaaatttttctactaagtaaatattacttacagccgccacaataacaatagcaaccactaacaaccataaaaagccattcagacctttcgatttctgctcaatttccggagccactttattttttgtaatttctaatgccataaattagtccatcatttaattttatactggaatcctatttgaacgagcaattctagcactttcttattttattgcctatcaaaaaatataaattacgtgctatttttaatcttaatgaaaaagggatctataagatcccttttctgtcgaaacctatacaaataggagttcggtattacttaataatcttagcaacaacacccgcacctacagtacgtccaccttcacgaatcgcaaaacgtaaaccttggtccatcgcaatcgggtgaattaagcttactgtcattttgatgttatcgccaggcatgaccatttcaacaccttccggtaattcaattgtaccagttacgtcagtagtacggaaatagaattgtggacggtaacctttgaagaatggtgtatgacgtcccccttcctcttttgacaacacataaacttctgattcaaagtctgtgtgcggtgtaattgaacccggtttcgctaatacttgaccacgttcaatttcttcacgttttgttccacgtaataacgctccaatgttttctcccgcacgaccttcgtctaataatttacggaacatttctacacccgttaccgtggtttttgttgtctctttaataccgacaatttcaacttcttcaccagtacggataataccacgctctacacgtccggttactactgtaccacgtcctgaaattgagaaaacatcttcaatcggtaataagaacggttggtcaatcgcacgctcaggctccggaatatagttgtctaagtgagatgctaattcaagaattttttcttcccactcagcaactccatttaatgcttgtaatgctgaaccacgtacaattggtgtgtcatcgcccgggaagtcgtattgagaaagtaattcacgtacttccatctcaacyaattccaataattcttcgtcatctaccatgtcgcatttgtttaagaatacgatgatgtacggtacacctacctgacgacctaataagatgtgctcacgagtttgtggcattggaccgtctgttgccgctaccactaaaatagctccgtccatttgtgccgcacctgtaatcatattttttacatagtcagcrtgtcccggacagtcaacgtgtgcgtagtgacgtgtcgctgtatcatattcaacgtgtgaagtgttgatagtgataccacgtgctttctcttccggtgcgttatcaatttggtcaaatgcacgtgccgcaccaccaaagtgtttggataatacagtcgtgattgctgctgttaaagttgttttaccgtggtcaacgtggccgattgtacccacgtttacgtgcggttttgtacgttcaaatttttctttagacattgagagtccctctaaaaaacacggttatcgatggtacaataacaccacattaacctaatgtatgatttacggtttaattaaaaggatagttgaaacaagaagtggtgctgataggcggatttgaaccgccgacctcacccttaccaagggtgcgctctaccaactgagctatatcagcgcctggagcgggcagcgggaatcgaacccgcatcatcagcttggaaggctgaggtaatagccattatacgatgcccgcagtccataattcaactgtcccatcagaattcattattaagaatggtggagggagaaggattcgaaccttcgaaggctgagccggcagatttacagtctgctccctttggccgctcgggaatccctccacgcaaaaatgaatacttgtttactttagaatggtgccgactaccggaatcgaactggtgacctactgattacaagtcagttgctctacctactgagctaagtcggcatcgtaagcaagtgaggcgtattatatggaaaaaattacccctgacaagtcttttttcgaaaaaaaaacactttttttattattcgattaataatcaggcaaaatatataaaaattgtgaaaaaaacagttgatttagtctctttccagatacttgttttagcatttataatgtatatttttatctctttctgtcattttaagtagaatttatcgtggaagaactcaacactattaaactttctgaccacttaacgccttttttaacttttaatcggcaacagtgggctgaattgcgaaaatcagtacctttgaaactaacagagcaggatttgaagccgctattgggttttaatgaggagctttctttagaggaggtgagtacaatttacttacctcttgctcgtctgattaattactatatagaggaaaatttacgacggcagactgtcctcaaacgttttctcagcgggcataatcctaaagtaccttatatcattagtattgcaggtagtgtgtcggtgggtaaaagtacatcagcccgaattctacaatcgctattggccaattggcccgttgcaagaaaggtagacttaattaccactgatggatttttatatccactagaaatattacagaagaaaaatttgttgcaaaaaaaagggttccctatttcgtatgatactcagcgattaattcgttttttagctgatattaaatcgggtaaaaaaaatgttaaagcaccaatttattctcatttaacctacgacattatacccaaccaatttgatattgttgatcgtccggatattttaattttagaaggtcttaatgttttgcaaattgggtctaataaatcaaatcaaatgttcgtatctgattttgttgatttttcaatttttgttgatgcagaggaggagcaattaaaagaatggtatataaaacgctttttaaaattttgtcgcagtgcttttacagatccgaattcttactttaaacattatgccaacttatctgaacaggaagccatcgaaaccgcaactcaaatttgggataatattaatggcttaaatttgaaacaaaatattttaccgacaagagaacgagcgaatttaatcctaaaaaaaggagaaaaccacaaagttgaattggtcaaacttaggaaataaataaaaaataccgcacttttttaaaaagtgcggtatttttatccatattttaattaatgtaaaacatcaacaatatttaaaaagatgtttaatgctacgctatttaacagatcgataaagaatgcaccaaccataggcacaattaaaaacgctttgtgagacggtccgaaatgagaggtaactgcttgcatattcgcaacggctgttggtgtcgctcccaagccgaaaccacaatgccctgcacttaatacaacggcatcataatcacgtcccatcatgcgataagtcacaaaaatagaataggcagccattaccacaacctgtgctaacagtacgactaaaattggtaatgctaatccagccaattcccaaagttttaaagacatcaatgcgatagctaaaaatagtgataaacccactgtacctaacacatcaattgcctcatccgctactttgaacttcacaacatgagcgagtgcattacgaattaccgtaccggtaaataaacaccaaacaaacgtcggtaattgaagtgcggttccttttgtaagcacatctaaatattgcccgacaatcagacacacggacatcatcgtaatggtttcaataattgaacgagtattgattttgcgacgatatacgggcttttcaaatacctcttctatatcgtccacattttcatcttccagtacttccgctttatgcaagcgtttcaataagaatctggctaccggtccaccgataatccccccgaaaaccaaaccgaatgtcgcacaagccattgccagttccaatgccccttgaatgccaaaacgattacttaaagtttctgcccaagcagctcctgtaccatgaccacccgttaatgtaacggagcctgcgattaacccgtaagcaggatctaaaccaacaagcatagaggttccgataccgactgtattttgtagaataattaaaccaagtgcggcgaataaaaagataacgagaggtttaccgcctttcgctagacgagcaaagttggcacttagaccaattgagctaaagaacactaacatcattgtagtctgtaatttagtatcaaaactaaaactcatatcccaaaagtgatgcacaatgcttaagataatagccacaataaagccaccaaccaccggctccggaatattgtattcgctcaagaaatgtacacgtttcactaaaaaatagcccagtaataaaaccaagcaggctaatgccactgtttcataagtaccaaaagtcatattaacccctttttttgattgttgttcctgtatatattattaaatcagatactaggataggaaaaattagcaaaatatttttgcaaattcagcaaggctgtggaacgtaacaaaaaaaagcatttttgtctagtaaattgcttctttatgtatcagtaaaagtaaaatttggtagatctatttagtcaaattcaagctcaaccgcattttctcctaacattgttaccagtgcactcaataactcatctgttggataaacagaccattgcacaccgaagcgtatcaaagctcgtccgtctttactttgatagtaaagatgtattggcaaagaaccgccgctaaaaggttcaataattcctttgagttggcgaataaagtgcggtgttatttgctcttgggataagctgatggctaaattttttgcataacgactacgagcttcatctaaagtcattaactctcgtacagacatttttagcccttgagaaaaatcatcaaaactgactgtaccggaaacaataacaacggtgtccttctgtaatttatcaccaaaacgttctaaagcatcagcaaacaacgttatatctaaaagcccggaacggtcatctaaagttgcaatacctaatcggtttccttttttcgtcactgcaaatcttaatgctacaattaaaccgcaaacagtacttattttgcctcgagtgtttggagataactcatttaaacgtgtcgaactgtaatgagacaactcttttaaataacgagtaatcggatgactgcttaaatacaaacctaatgtttcacgctcaccgtctaaaatttgtttctcgctccaacgtggcgtgtgtgcataagcggtttcaacatcttcatggcttgaagttagtacaccaaacatatcaacctgtcctatcgcctcatcttttgcatgctgatccgatgctttcaacgcatcttccaaattttgggcaagtgcggctcgatgtggacccaatttatcaaacgcaccggatttaattagattttcaaaggtgcgacgattaatctgttttaaatctactctcgcacaaagatcgaataaatctttaaaaattccgccttgttcacgggctgaaactattgcatttattgggacttctccaacgccttttatcgcaccaataccataaacaatttcaccattatcattcacactaaaatgatgtttgcctgtattaatatcagggggaacaatagtgagacccatacgtaaacactcatcataaaagctcacgatcttgtctgtgttatccatctctgaggtcatcaccgctgccataaattcagcgggataatgtgtttttaaccaaagggtttgataagaaaccaaagcataagcggcagaatgagatttattaaaaccataaccggcgaatttttccactaagtcaaagattttcatggctaaatcgccatcaatcccttttgctatcgcacctttttcaaaaatatctcgttgtgccgccatttcttcaggttttttcttacccatcgctctacgcaataaatccgcaccgccaaggctgtatcccgccagtacttgtgcaatttgcatgacttgttcttgataaacgataaccccataggtaggttctaaaatcggcttaagggattcatgttgatacttaacatcaggataagaaacaggttccactccgtgtttacgatcgataaagttttgcaccattccagactctaaaggaccggggcggaataatgctacaagtgcaataatatcctcaaaacagtcgggctgaagtttcttgataagctctttcattcccctcgactccagctggaagactgctgtggtttcagcttttttcaacaagttaaatgaatcgggatcatttaaaggaattgtcgaaatatctaccgcacttttaccctctttaactaaacgagcgttaatcatatccaatgcccatttaataatggtcagcgtgcgtaagcctaaaaagtcaaatttcactaatcctgcatattcaacatcatttttatcaaaatgtgtaacaggatgtttcccttccgagtcgcaatatagaggtgagaaatctgtaattaaactaggagaaataactacaccacccgcatgtttacccgcattacgtgttactccctccaattttcttgccatatcaattaaggctttcacttcttcatcattgttataaatttcggataatctcggttctgcctcaaaagcctttgtcaaggtcatacccggatcggcgggaattaatttagcaatacgatccacaaaaccataagggtgtcccaatacacgccccacatcacgaataaccgcttttgccgccattgttccaaatgtgatgatttgcgaaaccgctccacgcccataagtttctgcaacatgctcaatcacacgatctcgcttgtccatacagaaatccacatcaaaatccggcatagaaacacgttcaggattgagaaaacgctcaaaaagcaaatcaaattcaagaggatccaaatcggtaatttttaacgcataggcgactaaagaacctgctccggaaccacgtcctggtcctacaggaatatcattatcttttgaccactgaataaactccatcacgatcaaaaaataaccgggaaagcccattttattaatgacatccagttcggtttgtaagcgatcatcgtattctttacgtttttctgaccgcacttgcggatcaggaaacagggtctgcaaacgctcctctaatccttctttcgatttttggattaaaaaatcttccggacttaagtcacccgttggaaatttcggtaaaaaataagtccccaaacgaatggtgacattacaacgttgtgctattaatacagtattttcaagtgcggtaggaatatcagcaaacagctcacacatttcttgctccgagcggaaatattgttgtgaactgtataatttcgggcgtttcggatcatccagtgtataaccatcatggatagccactcgaatttcatgtgcctcaaaatcctccggacttaaaaaacacacatcatttgttgctactaaaggtaattgtttttgctgtgcaagtattaaagcagattgaatatagcgatcttcatcggatcgaccggtgcgacttaaacttaaataaaagtggtcgggaaaatattcttgataaaaagctaccgcagtttccacatcaacagaattatttttcagtaattttttccctacatcgccattgcgaccaccggataaaatgataattccctcatgatgttctgccaaccaagactgatcaatgtaaggtaaattataataaccacgttcataagccttcgaaagtaataaggtaatattatgataaccctcgttatttttggctaataacgtcagttcaaaaagttcatctcccaacaaatcacttttcacgagaacatcagcaccgataataggtttaacgcctgaggattgtgcttcaccataaaaacgaactaagccacaaaagttagtaaaatcagtcaatgccattgccaccatttcatgttgcacacaggcttttatcaaaggttttaccttagtaatgccgttaatcatggaaaaatcactgtgtacacgcaaatgtacaaaacgaggctgtgacataaaaaatcctataaaaataatttgagggaaaaagtgcggtgtattttagcgatatttctcaacaagctcaatcaaaggcaaaggacaaaaattccagcaaattattaccgcactttgaaaaaaagaaacccgactaagcgtcgggtttaatttagctaaaatgaactactgttttgcaacaaccttcccatcaacataatccacaatgacttttttacccggtaataattgtccggataagatttgttgtgctaatggattttcaatttcttgttgaatggcacgttttaacggtcttgcaccgtaaatcacatcgtagccgacttcaccgataaaatctaaagttgcatcggtaaattcaagctgataaccatgggtttccatacgtttcactaagcgttgtaattgaatagtggcaatggcacgaatattttctttagctaatggatggaataccactgtttcatcaatacggttgatgaattcaggtcggaaatgttgccctacaacggacataacaacttctttcatagcattataatccaactctttattgccttgaattaaatcagagcctaaatttgaagtcataatcactacagtattacgaaaatcaaccgttctgccctgtccatcggttaaacgtccgtcatctaacacttgcaataaaatattaaagacatcgctatgggctttttctacttcatcaagcaaaattacggaatacggacggcgacgaacggcttcggttaaataaccaccttcttcataaccaacatagcccggaggtgctcccactaaacgtgaaacgctatgtttttccataaactcagacatatcaatacgcaccatggcattttcatcatcaaacataaagttagcaaaggttttacaaagttcggttttccctacgcccgttggtcctaagaacaagaatgagccaataggacgatttggatcagataatccggcacgactacgacgaatagcatttgcgacagcaacaaccgcctctgattgtcctacaacacgcttatgcaattcttgttccatacgcaataatttatctttttcgccctccatcatttttgcaacaggaatgcctgtcgcacgtgaaagcacttcagcgatttcctcatcggtaacacgatttcgcaataaagtcatctcttttccttccgcactttcagcttgtgcaagctgtttttccagctcaggaatacgaccatactgcaactcagacattttcgcaaaatcactgattcggcgagcttgctccatttgaattttggcattgtccagctctgccttgatgtgttgagcacccgaaagtgcggctttttccgccttccaaacgtcttccaactccgcatattcacgttctttttcaccaagctcttcctcaagaagatccaaacgcttgcgacttgcttcatcatcttctttttgtaacgcttgttgttccaattttaattgaataatacggcgttctaatctatctaaaggttgtggcttactatcaatttccatacgaatacttgaggctgcctcatcaattaaatcaatagctttatccggtaattgacgatcggaaatataacgatgagaaagggtcgctgccacaacaattgccggatcggtaatttgcacatgatgatgaatttcataccgctcttttaacccacgtaaaatggcaatcgtatcttcaactgtcggttcaccaacaaataccttttggaaacggcgttcaagtgcggcatctttttcaatatattggcgatattcatctaaagttgttgcacctacacaatgcagttcaccacgagctaaacttggctttaacaaatttcccgcatccattgccccgtcagtttttcccgcacctaccatagtatgaatttcatcaataaataaaatcacacgaccttcttcttgtgccaattctttgagaaccgcttttaaacgctcttcaaattcaccacgatatttggctcccgcaattaacgctcccatatccagagaaagaacacgttttccttttaagccttcaggtacttcaccgtttacgatacgttgtgccaatccttccacaatcgccgttttacctacacccggttccccaattaatactgggttattttttgtacgacgttgtaaaacctgaatggcacggcgaatttcttcatcacgcccgataacaggatccaattttccactttctgcccttgcagttaaatcaatagtatatttttctaatgcctgacgattttcttccgcaccttgttcattcactttttcgcctcctcgcaatttatcaatggcttgtagtaaattttcttgttttataccgcactttttcaaactttcacttaaagcacctttatcttcaaaaattgctaataaaaataattcagaggaaataaatttatcttgccgttgttgtgccagtttgtcgcataaatttaataatttgaccaaacttctggaaacctgaatatccccattattccccgaaacttgtggtaaacggctcaattctgcagctaattcattatgcaataatgctaaatttcccccacttgctgttaataatggcgggattgaaccatcttgctgatttaaaagtgcggtcattaaatgaactggttcaataaattgatggtcttttcctatggctaaagattgagcttcagcaatagcttgttgaaatttagtggtaaatttatctatgttcataatctctcctaaaattaatttctgcgtttcatcgtaaaaattaactacataatgaaacgccttctattcgctcactagttaagtaagattaaacaaagatatttcaagtagaaaagtaaaataaatttagtaaaacctattaattaaatgaattttaataggttttacaataaatagagggcattaatgaaaaagttttttcccaaagaaaaataacaataaaccgaaaccgatgacaacaaaaccgataagttgccaaacatttaccgctctttgcgtcattccgattaaaccgaaatgatcaatgatcaaagcagtcagtaattgaccgacaataataaagaacagcatattggtgacgccgattttgggtgcaagaaagatagtggtaaataccgctaatgcacctaataaaccgccgatgagtttccataagggctgtttagggacttgttgtagtgctgaaaataaatccattttccaccagcaaatgaaaaataacgctatcgttcccatcgcaaaggaaacaaaggctgcaaagacaggttgtcccgagagagattgtgctaactgagtattaattgccgcttgtgcggctaatgcgatccctgcacataatgcaattaatataaatggaagtaacatttttattatcctttaaaaaattcagtgaaatgaattgcattctatacttttcaagcaaagatacaaaagctaaaatgtcgcaataatataaatcctataacatgtgctccaagttcaaactttttccataaaaaatgtatgatagacatgttattaaactaaatagcttttaagggaataattatgacaagcacaaacgtacaactcatacaagaaggcgtaaatctaatgctttccggtatgggctttgttttagtctttttattaattttaatttttgctataaaactgatgtctaaacttatcggttacttgtcatctgaaccaacccttcctcagcaagcatttattcctacaacagaattaaatgatttagagcgtttacgtccggttattgtagcagtaatagcacatcaccgtcgtcaacaaaatttacaataacggagaatataaatggctactcacgagaaaaaaatttctataactgatgtggttttgcgtgatgcacaccaatccctttttgctacacgtttacgccttgatgatatgctacctattgcagccgaactggataaaatcggctactggtcgcttgaagcttggggaggtgcaacttttgatgcttgtattcgctttttaggggaagatccttgggttcgtttgcgtgagttgaaaaaagctattccgaacacgcctttgcaaatgttattacgtgggcaaaatttattgggctatcgtcattatgctgatgatgttgtaaataaatttgttgaacgtgcggttgcaaatgggatgagcgtatttcgtgtattcgatgccatgaatgatccaagaaatatgcaacaagcgttaagagcggtgcgtaaaaatggtggacatgcacaaggtacattgagttatacaacaagtccggtgcatactttagaaacgtggttagataccacagagcaattgttagaaatcgggatcgactcgctggtcattaaggatatgtccggaattttatctcctgtcgaggcatacaaattagtcagcgaaatcaaaaaacgctatgatgtgcgtttacatatgcactgtcattcaacgacaggtatggcggaaatggcattactcaaagccatagaagcaggtgcggatggtattgacacggcaatttcctctatgagcggtacttacggacatccagcaacagaggcattagtagctacgttagataacacacagtacgataccggattaagtattccacaacttgagcgtattgctgattatttccgtaatgtacgcaaaaaatacgctaaatttgaagggcaattgagaggcgtggatagccgtattttagttgctcaagtaccgggaggaatgctgactaatttagaaaatcaactcaaacaacaaaatgcttcagataaactggataaagttttgcaggaaattccaaaagtgcgggctgatttaggctatattccgctagttacaccaacctcacaaattgtcggtactcaggcggtaattaatgtattaatgggtgaacgttataaaaccatcgcaaaagaaaccgcaggtattttaaaaggcgaatatggtcgcacaccagctccagtaaatgcagaattacaagcaaaagtcttagcgggtgagcaacctattactgatcgtccggcagatcatcttgcaccggaaatggataaactatccacagaaataaaacgaatggtaaaagaaaaaggtattcaacttgcagagaatgaaattgatgatgtattaattgttgcacttttccctcaagttggattgaaattcttagaaaatcgaggtaatccgaatgcttttgagccggtaccaaccaacgaagtaaaaacaagtgaaaaaccgaccgcactttcaagtagaaatgatagtgctgtttacacggttgaggtagagggaaaatcttttgtagtgaaagttactgaaggcggtgatattagtcatattacacctgtctcgaccgcacctagcacacaatcaacagaatcggcaacaagtgcaactacaaaaaatataccggtaaatgcacctatggctggaaatatctggaaagtactggtaaaagaaggacaacaagttgcggaaggagaagtcttgctcattttagaagcaatgaaaatggaaacagaaattcgagctgctacctcaggaactgtacagggtataaaagtgaaagcgggtgatactgtggctgtgggtgatatcttattaactttagcgtaatcggagattaatatggaaagtattctcgccctattacaaggaacaggcattatgcatttaagttgggggcaggcaattatgcttgtcatcagcttgctcttactctaccttgcagttgtgaaaaaatttgaaccgctcttattgctaccgattggatttgggggactcttatccaatattcctgaagcgaatatggcgttttcggcactggaaaatttacttcatagcaacaacaaccaacatttatctacgcttgcaaatttactgcatagcgataccgacgtacaggcaataaaacaggtactggaaaaagcaccggcgttgttacatgtgcaagcagaattattagcgaaagatttaggctataccgatggtgtgttgtccactttttatgatgtcgccattaattcaggtgccgcaccattgattatctttatgggggttggtgcaatgacggattttggtccattgcttgctaatccaaaaaccttattactgggtgcggctgcacaattcggaatttttgccactgtgctaggggcgttagcattaaacgggttagggatcattgaatttaccttgcctcaagcagcggcaatagggattattggtggtgctgatggtccaaccgctatttatctggcaagtaaacttgcccctgaattattgggggctatcgccgttgccgcttattcctatatggcattagtcccacttatccaaccgccaataatgcgtcttttaaccactaaacaagagcgtaaaattaaaatggtgcaactgcgtaatgtcagtaatcgggaaaaaatcttgttcccgatcgtgttattggtgcttgttgctttattattgcctgatgccgcaccgttattaggaatgttttgctttggtaatttaatgagagtaagtggggtagttgagcgtttaagtgatactgcacaaaatgccttaattaatattgtaacaattttcctcggattatctgttggtgcaaaattagttgcagataaattcctacaaccgcaaacgttaggtatcttattgctcggcataatcgctttcgccatagggacagcgagtggcgtcctaatggcaaaattgatgaattgctttagtaaagataaaatcaatccgcttatcggttcggcaggtgtttccgccgtgccaatggcggctcgagtatcgaataaattaggcctagaggctgatcatcagaactttttactaatgcacgcaatgggaccaaacgttgccggcgtgatcggatccgccattgcagcaggcgtgatgttaaaatatattgcagcaatgatgtaaaaatcattcccttaagattgaaaataaaaataaggacgaaaattttcgtccttattcatttttaatacaatgttagaatttctctagtaacattttttccaatttttcttggtcaatagcaaacttacggataccgtcagctaatttctcaactgccattggatcgctattgtgttgccaataaaattggctttcggttaacggttgaggttttgctttaacttcacctttaaacgctaatttacgcacaagtgcggtgctattttcttgtaattcttttaataatgccggtgcaatagtcaaacgatcgcaacctgccaattcagtaatttcacctacattacggaaacttgctcccataacaacagtgttataaccgtattgtttatagtaattgtaaatttttgtaacagaaatgacgcccggatcttccgccggtgcatattctttcttatcactgtttgctttataccagtcaagaatacgtcctacaaaaggtgaaattaaataaacacctgcttcagcacaagctcgagcctgtgcttcagagaacaatagcgttaagttacaattaatcccttctttttcaagaatttctgcagcacgaataccttgccatgtagaagcaattttgatcaaaatacgatcgttgctaatacctgcttcgttataaagtgcgataagtttacgtgctttttctaccgttgcttgtgtatcataagaaagacgggcatctacttcagtagaaatacgtcccggaacaatttttaaaatttctaaaccgatatttactgccagtttgtcttctgcatcaattagttgctgtgttttatccgcactttttgctttcgcataagcaatcgcttcatcaattaatggagcatattgcggtaatgatgatgcacttaaaattaaagagggatttgtggttgcatcttgcggttgatattttttaatcgcatcaatatctcccgtatcggcaactaccacggtcatattacgcaaagcgtctaattgtgttgtcatagtctttccttttatttagctataaagaattgaactcgcatacaataccatatctttgaaattatgaaatcattattttacttttaagcgcacagaataagtatattcttcaccttatttataatgctttttagcacaattttatttataatcgagggcaatttttggcaaacaaaatagctcaacaatgaaaaaaaattattacactgtactttctctgtcaattttgaccgcactttatagcacgtccagtcaagcgaacttacaacagcaatgtttgatcggtgttcctcattttcaaggtgaaatcgttcaaggcgatcccaatgaattgccggtttatattgaagcggatcacgccaaaatgaatcaatcgacacatgctcaatacgaaggaaatgttaatgttaaacagggcaaccgtcatttaacagcgggaatgattgaaattgagcaacacggaaaagataatgcgaaacgttatgcgtatgctaaaaatgggtttgactacaaagataatttaattcagctcaatggtgataatgctaaaattcaccttgatagcaaagatgccaatatccaagatgcagattatcaattggttggacgacaagggcggggaactgctgatgaagttgaacttcgtgaacattatcgagtgatgaaaaatgcaaccttcacatcttgtttgcctaatagcgaagcttggtcaattgaggctaaggaaatgcgtcaacatattcaagaagaatatgcggaaatgtggcatgctcgttttaaagtatccggtatccctattttctacacgccttacttacaattacctatcggtgatcgccgtcgatccggattacttattcccaaagcaggtatctcaactcggcatggttattggtatgcacaaccgttttattggaatatagcaccaaactttgatgcgacatttacccctaaatatatgtctcatcgaggttggcaattaaatgcagaaactcgctatctgactcgtatcggtgagggaaaatttgtcgttgaatacttaaaaacagatcgtcattctgactatttaaatacggctcgttcacgtcatctcttttattggggacataattctcattttctaaaagattggcgtttaaatgtaaattatacaaaagtaagcgataaacattatttcaatgattttgagtctgaatatggaaacagtacagacggatatgtagatcaacaggcgagcatttcttactatcaaccgaattacaacctttctatttcagcgaaacaattccaaattttcgataaagtagatattggaccttatcgtgcgttgccacaaattgattttaattattatcgcaacgaaattgctaatggcttagttgactttagtttattttcacaagtagttcgttttgataatgacagtgcgttaatgccaactgcttggcgtttccatatagaaccgagtttgacttttccactttccaatcgttacggcagtttaaatattgaaactaaactttacgcaacacgctatctacaaaaacgaggtaaaggagaaaatgcagaagagattaaaaaaacggttaatcgtgttttaccacaaatcaagctggattttcaaacggtcttagcaaatagacaaagtttcattgaaggttatacccaaactcttgagccaagatttcaatatttgtaccgcccttataaagatcagtcggatattggtctaaaacaacaaaataatgattacttaggtttcggttacgactcaactttattacaacaggattatttttctttgtttcgagatcgccgttatagcggtttagatcgcatagtttcagcaaatcaaattactcttggtggaacgaccagattttatgataaaaatgcaaatgaacgctttaacttatctattggacaaatttattaccttaaagactctcgcacagataataatccaaaaaatacggctcaaggcagatcttcttcctggtctttagaaagtaactggcgtatcaatagcaaatggaattggcgtggaagttatcaatatgacacacatttaaaccaaacatctttggcaaataccgtcttagaatacaatccggagaaaaacaacttaatccagctcagttatcgctatgttaaccaatcttatatcaatcaaaatttgaaaggtagaaatacttatcagcaaagtataaaacaacttggtatgacaacagcttgggagctaactgatcattggacactggttggtcgctattatcaagatctcgcattgaaaaagccggttgaacaatatttgggaatacaatataactcttgttgctggtctataggtgttggagcaagacgttatgtaaccaatagagcaaatcaacgcaatgatgaagtgctttatgataatagcttaagcctcacttttgagttacgtggattatctccttcggatcataaaaataatatagatgaaatgctgaaaaaaggaaaactgccttatattaaagcctttagtctatactaacgttcaaatttaacgaaacacaccaaaaaacaaaccgcacattaagtgcggttttcttttagattatgttgaaaaattacagtacatcaacacagttcaaatcttcgaaagatttttctaaccgtttagacatagattcttctgctttgcgtaaccaaactcgaggatcatagtattttttattcggtgcatcaggtccttccggattacctaattgaccttgtaaataagcttcatttgctttatagaagtttaaaacgccttcccaagttgcccattgagtatccgtgtcaatattcattttaattgcaccgtagctgatcgcttcacgaatttcttccgttgaagaacctgaaccgccatggaatacgaagtctaatgatttcgccggaagattacgttctttagaaacaaattcttgtgatgcacctaaaatagacggttttaattttacgttgcccggtttatataccccgtgaacattaccaaatgctgctgcgatagtaaaacgtggactgattggacttaattgatcgtaaacaaaaaggacatcttccggctgagtataaagtttagattcatcaacatctgagttatctacaccatcttcttcaccgccggtaataccgatttcgatttccaatgtcatccccattttatccatgcgggcaaggtattcacgacaaattgccatattctctgccattggctcttcggataaatcaatcatgtgagatgagaacaatggtttgcctgtttcagcaaagtgtttctcgcctgcttccaataaaccgtcaatccaaggaagtaatttttttgccgcatggtcggtatgaagaataaccggaacaccatattctgccgctaatgtatgaacatgtttagcagccgcaattgcacctaatacatccggacgaataccgctagccggtttaattccttttcctgcataaaacgccgcaccgccgtttgagaattgaataataacaggtgcttttactcgtgcagcggtttctaatactgcattcacagaatctgtcccaacacagtttactgccggaattgcaaagttatttgcttttgcgtaagcaaatactttttgaacgtcgttaccggttaatacaccaggttttacaatgtctagtaattttgccatttttatatttcctatataacgtgcaattcttgcactactaaaaattaaatcaatctacaacgtaaagtataatgcttttcactttacaaaattaaccatttgctcgtttttctaaaatttcaaccgctggtaatactttgccctctacaaactctaagaatgcaccgccaccggtcgaaatataagaaattttatctttgataccgaataaatcaatcgccgccaaagtatcaccaccaccggcaatagagaaagcaccatttgcggttgcttcagcaatcgcattagaaacgatttcagtacctttacgaaagttagggaattcaaagacccccacaggaccattccaaagaatagtttttgcattgcggataatatcagccaattgctctgctgatttatcaccaatatcaaaaatggattcttctccggaaacgtcggctacacttttttctgttgatagtgcggtttctgaaaattcagtgcccacacgcacatcaactggaacaggaatattcgttacttttgataaacgttgtgcttcaggaattaaatccgcttcatataaggatttacccacattatgcccctctgcagcaatgaaagtattcgcaataccgccaccaacaatcagttggtcagcaatttttgataagctgtccaagacagttaatttagtggatacttttgaacctcccacaatcgctaacattggacgctgaggctcttttaatgctttacctaacgcctctaattccgccgctaataatggaccggcacaagcaacaggggcaaactctgctacaccgtaagttgaggcttgtgcacggtgagccgtaccgaaagcatccataacaaatacatcacaaagtgcggcatattttttacttaattccggatcatttttcttctcacctttattcacacgtacgttttcaagaacaacaatttcaccttcattgacttctacaccgtttagataatcttgcgctaaacgaacattaaaaccggcacctttcaaataatcaacaacaggctgtaatgaatcttcaggtttaaattccccctctgtcggacgacctaaatgagaagttaccatcactttagcacctttctcaagtgcaagttttaacgtaggaatagttgctttgatacgtgcatcggaagtgactttcccctcttttaccggcacatttaaatctgcacgaataaatactctcttacctgctaaatctaggtcggtcattttaattactgacataattcaccccttatattggttaaaattgataaaaactaccgcacattatacctagttatgaacaggttgtaacgaactagatcaaattggctttaatatcttgttgcataaattaaatcattaacaaaaaactcacgtttctattaataataattcaatccggaataactgaaatccctattcagttttcaacggatattctttataatcagccctttttacaacagagttaaaggacatggcgttactcatcactgataaatgtacaaattgcgatatgtgtttaccggaatgccctaatgatgccatttcaattggtgatgaaatttacattatcgatcctcatctttgtacggaatgtgtgggacattatgatacgcctacctgtcaaaacgtctgccccattaccaactgcattaaaaccgatccggaacatattgaaacggaagaacaactttgggaacgttttgttttaattcatcatgcagacaaaatataaaaaaaagggcgtataaacgcccttttttgatggatgaaaagtcaagaattaccagctataaccgatacctgcacccacagaagttttcttatcgccatgtcctaagctgaacttaacgctaagtttaccgttatcggacactctggaataacctaccgcaaaggcttgactccccatatagttaccggtcgccaaacttaacgtacttttacccggtaatatattgatcggtaagttcgcttgtgcaacagcttgtgccacacccgcacgcatattgcgatcattattgttcatttgtgtccgcagttcattgtttttggtatccacgtagtttttgtttactaccacatgaccatctgcattaggtttaatattcggcacggtgataaccccttttgtaccatcaatgtgaatctgaccgtctgcaccgttcactgtcaatccgtttttattcagctcggtacttagtgcggtcgcttgggttgaactgtccgcaaaacggataccacctgcggtcatcacagccttatcgcttttgtttttatcttccaacaccaccgcttccgctccataagttgcagatttggctttatcatcagtgccatctttgcctttattgaccactctcaagccgttgctgtctaaagtagattttctaccctcaacttcacgggtttcaaangaggtcatatttttcaaytgatcrgacaatttmacttctaagcctttrccgtcttgtgccatttccactttgatattgccggtrgcagtgcggtygctgttaaatgttccctcgcctgtgatggacagggtttcacyyasmtktttaygcacggttacatcatcattaccgacaaaattcarscctgmtyttgcyacggcttgcaaatcgccaayrgtagcgacattgsttaamtyrgcttsgctatccgrttcaaccagttcttcgacttttgcyatcgcctcggaaaargcgttatagtccccatttgcttcrattaactcgttgcgtgccgattytacggcttctttrgcrtymtytttarcctyttsggmagcwgayaaytsckyttsrtatttttycaaatcctcaygcattttttctttagcttytccatcaggcatggtatccactgtttgttttaaactgtctaccattaactstaartcagcaaatttttctgctttttcagaaaaatctttyrttttttyrcctaatgccgtcactttttcactcacttyctcagcaagytgattaagttktkytttttswtcgtctgttggtgttgtratacccaaaccrcttgccacattgctaatcccrataggtgcggtggtcggttcggctttaatcacgacytgtttcttctcttcctcagtaagkgcttgatcaggtttaccgtcttttaattttttgaaattaccatctttatctttcacgactttttcgcctttcagataaaaatcaaayggrcgrttattgtttaagtcggayactttttyatccacatartttttattcgctgcaaggstkccrtctgtttcmtcyggyttaatrtcmgcaagaccggtgattttgccggtgcctgtgccttttgcatcagcacctgttccagctccgcttccatttccgatttttgcaaacgcaagggtagcggattgaccgttaccaccattattgccttgactgttttcaccgtcagccactttcaagctcacgacttcttttgaaccgtctttgccttttacagtcaagccgtttttaccataaacggtatgggttttgtcgccgttagctgcctctttatcgcccacggttaagccgtctttgtttaaggttgctttgccatctttgctttgtggtgtaagtgaaataccatctttattgatatttacttcagtaccttgattgccaacttggaatgtsgcacctttytcygcwtctaamgtmagtttrgtgacttcatcttgatttccaaccgcacttgaacctgtaccgcttccgcccgcacttccakctttaggtttagaggaaatygawgtkatrtttttcarwtcctcagtygtgccaatggttaccaywgccgttgttgttggggtagtggtggttggcgtggtagttggtgtacttgttggckttgtcgtagccatgcctgcaccatttgaaccacctgacgaagccatactatttgaaccaccgccgtttgaacctgcaccacctgatgaactgcttggagctgctgatgatrctggtgctggagcagctggtgttggagccggtgcggaakcactcggactggtagatcccgtacttgatggtgttgtaccgtttttagctaaatctactttaatattctgaccactcgtaaayttcaacgtatcgyyrcgaccgatttcrayagkytkaccgcyaccattttcaaccttgaacttaaacttatctaatgcttgttcaaggtagcctttagtgatgagttcttttttccaatctgtacttccgctatttccatttacgccattatatgtttgttcttcagcaagcattactttgctaaatgtcggtgcatttttaaagccgatttcgattttggcgttgccgttagcttctctcgtgtattgagtgattaaattatcacctttaaactcagcaatatttggttgtgatgaagtccccgccggagctggtgtagcagacgaaccagcctgattcatatctaaacgmacaatrytaakggtygarccragatagtgcggtgtgttttgagtgccrtttgctaccgcacttggcawatccgcaytgaayttcaarccytcgttgagtttagaaacagcatttttcaagccytcaacgatattttttggtrcagttccatckkttccattaatgycttttaatttgaartyatcaaawgttggwgckktaaakktsgttttatctgaagtatcaacckcaatacctaaytgwttcgctaaatccgccagttgtttacctgttacggcktcttttgaactatcaccgatttcaccgtctgcaaggtttgtgagttttgaatcattaaagctgatttcttttttagctgtttctaacgtgattttcgcaccgctttcatctttaccacctttgatactggtgatttcttkaagmtyattattmarcgtatgcgtaatttttccatcagcttcyacagmaacagaaatattttcygacttcwyraagtccaamgcccctgttttgaggttgatagattgcttcgttttgtcatcactattcgytttatacgataacgtcaagtcgtccacatatttcttattracggcatcgtatttatcagttggtgtrgcaacataaacaattcttctttgttcatctttgccagcaccacctacagataccgcattggmtacacctgttgatttattgcctaaaatgacagcatttgttatatctttagttatcgtaatatttgaacccaaggcataaacatggtcgccctcaattttgttataagcacccacagcataggaatgctttccgataatctcattatctttaccgaatgcaccggaatcgttacccgatacattatttttgtagccgatagccgtagcatgctcgcccaatacctgagcttctcgacctatggcaactgaacgtctatttttagcactcgtgtcataaccaatagcaattgccccttcattttctgctactgctttatcgccaatcgcaatagaaccctctccatcagccttagtttccggattatcggatactttaacggatttatcacctgtaccttttagatattctatcaccgcatcagcctgtactaattctgttgaacttttttcagtatcgccaagtttgatttcagcaataccgacatttttgcctaannnnnnnnnnnnnnnnccaatattcgacccatcgacttttaagaagtctgtttctaattttgcggtcggtgtgtactctttcaatttctccgctaccgctttagaagtcacgactttttcatcgctgtcagaaaccgtggttgctttatttaatttcagcgtaagtgtacccgcactttgaggattgttaccattagatggtgctaatgatacggtgatgtctttttgtgtggcttctgccataccatcggcttttaccttacttgttgaactatcaatggtcaacgtaccgcttaattgtaatgtggttgagcttggggagctaccattatcattccccttgaatgtcaatccaccattaactgcggtgattaactgattaatagcctctttaaaagttgtaggacctgtattgctattagttgtaccaccagttgaacttgtaccaccttttatcgggttaaatgatggtggtttaaacgtagtttcactctcaacatcaacccctaaatgagtagctaaagcatgcagttgtttacccgtaatggcttcagttgaattagtatcaatttttccatctgccacatttgagattttcacggtatttccggtagtggctttagtaaatgtcaatgcacttccacccacttttaactccgctgttttatcagtgccacttgtactgtttttaaacactaaggcgttactatcatctttaccgatggtagacaagccggtggcttgcactccgccatttgctgtgtcctttgcaaacgtaacagttgagccgttttccgggcttaactcgattttgttatccgctccattagtaactttaatactacccttatttttacccgcacttaacgttgcactagtaccatctaaagtaacgcttgaaccatctttagtactttctaaggtnnnnnnnnnnnnnnnnnnnnnnnnnnttgaattatctttcgcactttctaaagtggcagtgttttcagtgagttttaacgcacctttgccctcttctttattaatttcagacacgccgctaaatttacccgcacttagggtgacatcttttgatcttgcttgatcgcctgcggtgaatgttatcgtccctttatctttatccaaagcgatttttgctttmtcrccattrgcratrgakksaataccttttaagtttttagacaatttaatttctaaggtgtcatcgccattgccagttttcttcgccacggtgatattgtccggtgcggtttccatnnnnnnnnnnnnnnnnnnnnnnnnnnnnnnnnnnnnnnnnnnncccacaattttcaatgtctcaccgagtttgcgnnnnnnnnnnnnnnnnnnatttccttggaatgacagccctttatttttcaattcattagcaacatgaagcaaatcgcctgcattgatggctttctttaatttgccatcatttgatgttccaccattttgcggttgtcctgtggcaacaagttttaacaactcgtctaaatcttgtctgccactagcaccattcattttttgctctaaaccgcttgtaatgcctgtgatttgtttgctgtttaagtnnnnnnnnnnnnnnnnnnnnnnnnnnnnnnnnnnnnnnnnnnnnnnnnnnnnnnnnnnnnnnnnnnnaaattcaatcttcggagtcgtgccacggtcacctttacctgcaatcgaagtgatatttttcagatcggcatttaatttatgcgtaatcgcaccgccagcctctgctgtgacagtgatgttatcatcatttttaaaatcaagaccttcggaaagtttaactttattatcacctgctccattagccttgtattttatctcttggttggcaatcgcttgctcgttttgagtcgctttactgtccacatattttttagtggttaaggcagtctctggacttttctcatttatttcttcagtgaccgttacttgtttaaaagatggtttatcttttatgccaattaaaagctcttttgtatttggttgatatgatgttttaatattatcgctactaaatccatcatcactggttgattttttatcgatattccctgctttaatgtgtaaggtatcccccagttgaagcgtgcctgttgctgtaccatcgcccacgaccagtcctttattcaccgcgacgatcaaatcatcgattgcccctttaaaggtggtttttccgttagtttctgtttgatcgtgataatttatttttgcaaatttaggttcatcaaatccggttttcgcactatcgacagtcacacccaatttgcctgccaaatcatgcaattgttttccggtaatcgcctcatttgaagcaccgtcaatttgcccgtctcccagtccagaaatcttgaccttatccgtatcggattttgtcaatgttaatgccgcaccttcttcaggcattaactttattttcgtatctgctaaggagatttttgttttgtctttagcgatagactcaattcccgtcaatgttgaacttaatccataagatattttcttattaaacttatctaattcaacagttaaattagaatcttttgctgcaaattctaaagtatttcctattaggttatcgctagtggtacctcctgccttaaccataaatgttttattaagtttatctttaataccttgatcgagttttgcctccgctattgtgttatcttttaattttgtccctgcaattgaagcatcttttaaacttaatgacgcattaccaaatacttttccgccaccagtaacttgaatttcatcgttaccagttaaagcattcaatccactttcaataactattttagaagccctgccgtcaccgtgttgaactttaacatctccagtaaccccatcaatagtaatttttcctgttttatttgtagcactatgaccaccactatcttttagagtgatagaattaatgtcttctaagtctttatttagtgctaccgtaaattctcccgtcttatcagaatttgttttagataatgaaacattaatattgcttcctgatttaatgacaacttttttgtcgttctcgctattttttctaacaaagtcattattcatagtcccatcactaaaggtaatacctgccccatttaccgaagtgagtgccccatcaagagcagataaagcatctcccactgtcgtatatgatgccttatttccattagctagcgtataagacggtgctgttacatttccgtctgcacctattttcgcctctccgcctaaagcactcacaacaaaattgagttgcaatttgttaatagcatcattatcagatgtaccatttgctacgttggaaattttaactttgccactagaaccagttaaatttaaactggaaccaccagctttaaggattgtcccgctatccgaaaatgcgatttgattattggtatctttaccaatagatgtaatgcccgttaaagcctcttttaatgtgatactgacttttttagcgttcttatccactgccgtggtgatatttttagtatcgccattaatatttaagacattgttctgtttatttaatgtatatactacgttattatcccccttaacatcaaaattagcggcgaaattagctaatttcccgtccacataggttttcgtggtcaatgtcgttccatcactattatccgcgactgttccactaattttgacttctttaaatgtcggtttatctttgataccgattaacagttccttgctggttgctagataggctgtcttaatattatcnnnnnnnnnnnnnnnnnnnnnnnnnnnnnnnnnnnnnnnnnnnnntcccgccttgattgttaatttatcacctaagtaatgcgttccatattcatcattagaatcgccaacgccaaaaataaatcctttattaatcgctgttgtattttgaccaatggcatctttaaaggtcatttcttttgatgtttgagtatttgtattcccattatatttaacaacatcaaaacttgattttttaaatccgctcgttaggtctgcttttgctcctaatacattaatagctaatttagaaaacgcatctactacgccatataactggcttccgttaatagcgtcggtggagtttacttccactttacccgcagcaacgtgagtaatcaggtgttctttgccggtatcgccaacactgatcaccgattttttactctgctctttgtcatcagcactgacaccgcctgtccagttgaatttaaggttgtcactgccgacagtcacttttgcttctttaggtgcggtcattttatcgacaggttttgcatttttacccaatgcgagcttatcgccatctaccgtaatcatgcctaatttgtttttggtattttgggcaaaactgagagtaatactttgtttatcctgctccacttttgtctcaatttcatcactcgttcctgccactttaagtttttcgtttttcaaattcactttaccggtcggaccgctatttttagaattatccgcctctaaccctaaggttgtactaatctcatcaattttcgaatctagataagttttaaccgctccggcggtgacaactttgtctttattgctatttgttgccgtattgtcatcaatgcttgttgctttgtgcaaagtaaaggtaatttcccctttgttgctatcagtcttagaagtcagatccgtaccattgcctttaatggtgagtttttcgcccaatttacgggtgatttcagagccggaatttccggcaaatttcagtcctttttccacaatcgctttcgccacgttggataaatcgctgacattgacagcatttcctttaattgttgttatgtaactgccatctaatatttttgaaacattttccggatttccgttcgctcccttaggtccatgatgctgtgtatttaacccgctttgtaatcgggtaattcttctatcggacatatcaaagcccgttctatcaaatgtatagtttgccccatttgatgaaattgttacatttgtcgttgcatttgacccatttgtgctattaaatgctatcttgctatatacagtatttttaccgcttttaatcccttctccagtaatacttgcaatgtcttttaagtctttatttaaagatatttccaactctttttcattagttttagcttcagtagtaatatttttatgttggctagcgtctgctttccccttaatatttaatgcactttgaacaatatagtttcccgtattaccatttacagtaaaactagttgcaacattggcaagttttccgtcgacatattctttcgttgttaatgtctttttatcgcttctatcattcacagtgccacttattgttacttctttaaataccggtttatctttgataccgattaacagttcctttctggttggttgatagcttgtcttaatattatcactgctaaatccatctacatcagcttttggtttatcgatatttcccgctttaatagttaacgtcgaacctaaattaagtgtacctgtatggctgtcagcgtcttggattacaattcccttatttaccgctgtaatcagttcttcaatagcatctttaaaaatagttttttgtttcttttgagaacctttatagtcaaccgctgtaaacttataactatcaaattgcgtgttattgggggtatttactgacacacctaaaatatcacccacatttttaagctgattccccgtaatcgcctgatcrgaagtttgcgaaatctctccatcggctaaatgcccgaatcttatcttttctcctatgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggtgttccatattttgtatctaccttatagaagttgccatctgttcctttaactaatttatatatttttccattatcttgcgtataataaacgactaagccttctctttttacatattctaaggcttttaattgtccaatcgtcgccacgtcagaatccaacgcacccggtgccaccccgacaatccgtcttaagcccagttcttgacttccactgttaccctttgtccaaccgactgaaatgatacccgctgatttatcagttcttaaactatagcttgacccctctggaacatatggggttaaatcaatggcttcttttccggttaaggttgctgtatttttgttagcatcctgataaaaatattttgtatgtgatttatagcccaaggcgacggagttttccatcgtcgcttcggtttcattacctaaagcgattgcactttttttactcgcttttgaattagtcccgaaagcaattgcattttcagaatttgcttcaatttttgcattatctcctaaagctatccctttttcagaataaacatatgattctgtacctatagaaattgctgacatttctaattctactttttcagcctcaagtccaaattttcctttctttaaatttgctatttttacatttttattttgactttgattttcaacttttgcactattacctattagtatagatttttttgaatgatcttttaaacttgcagaatttcctagaactatactttcacttgataatccatgagaaccataccctattgatattgtattgtcttttgtaacaccaactccggaacctattgcaactgctcctgcaccgatgacatttattcctgtaccgatagcaacagagttttctttatatacattagtaccaatcccaagtgcgatggtatttcgtgcatatttaccgatgttatttaatgcccctaatactacagagtttgctcctcttactactgatgcactacctatagtaatagtattatccccattatttgaaagatgatatcctaaagatatagagtgatctccttctttagttgttttatatattttacttgttgtttcaatgacttcatccctttcgtgactaaaggctattcgttttttgtcgctaattactttttcaattatctctgatattggatttttactattactagggttagaagcattaaaaccaagtttgacaatatgattttcatctccgtattttaaattgttctcatcgattttaaaaagggtgttatattcattatgtcgatctacttctacaacaggagatgaattttgtgtgtgttgcataatggaattttgaaatgtctcatacccattacttgcgattaaagcattagatgctacatttgaccctatggctattgatccaattcctactgcttttgatcctgaaccgaatgttaatgcaccttggttagttgcttctgtttcattacctatagcaaatgaattcgcagcaaaaacccttgattcgtctcctatagcaactcctccagttgcatcgtcattaacaaacgcacgaactccaactgcagtagaatcatttgctaaagcaaatgataatgtacctatagctagtgaagcatttccataggcaacagatcttgaaccaatggctattgatgccacgcctgctgcgtaagtaggagaataaatccggttatctacaccgttatttattccgtattttatcttaaagttctgttcatttaatatatttttataagtagttccactatatcttgtgtttgtatcataaccatagattttcataatggttttttcaggtaatttgtctcgatatgtattagctatatcatcattccctattgcaatagaagcataaccagcagccattacgtccgatcctaaagcagttgcttgttgccctccagaatatacattgtttcctattgcagttgtttgagaagcaaaacctacagcaccatggcctaaaatagtcatacctacaccagtagattgatcgtgattcgtattcacgcctgcagagtgagggcctattattacagacttatatacattagtattaacatctttatcatatttacgaggactattttgaacctgtgttagaagagtgttttctctaccgttttttttccaataatctgcttccctccaattttctcgtacacccgctgctccggtatttccgtccatatcaatatatgttatgtcagcatatgaaacactgctcacaccaagcatccccgacatcaacaacaccaacggtgaaaatttaaaaatgcctaaaaaattacccaaaaacacaccgcactttggtttactcttcgaactgctcgctatttggcggttgcttgccaactcagaaacrgctttacattgacctgttgttacatcgtattttgttttgaagattttgttcataaattcactctctttaatcttttaaaattaggttttttattgatttattttgttgatttttttaacttttttatagttattaatggattaaaatttttgctttttaggcagattaatgaggtataaatcggcgatgccttgctttttaagacaaagcagaaaaaggcgaataatactttcgccgaaaggttgaggttgaaataggtgatttttaagatattgtttgaacatgtccaacctctcaaaattaacttgaaaggttgattttagccaatatactaggctgtaggctgtaggctgtaggctgtaggctgtaggctgtaggctgtaggctgtaggctgtaggctgtaggctgtaggctgtaggctgtaggctgtaggctgtaggctgtaggctgtaggctgtaggctgtaggctgtaggctgtaggctgtaggctgtaggctgtaggctgtaggctgtaggctgtaggctgtaggctgtaggctcattttattcctgtgatatgtaatgtacaaataatatatcgagccgactattgtaacctaaatattatgaaaaacaaaaggattttttagttaaatctgatttgatgtaagaaggctttagtgcgttcatgttgtgggttttcaaataacgtttttggcgatccttgttccacaataatgcctttatccataacgaccactacatctgccacatctaaagcaaatttgatttcatgcgtgactacgaccattgtccaaccttcgttagcaagctctttcatcgtgtttaacacatcttgaactaattcaggatccagtgctgaggtaggttcatcaaacagcattaattcaggtcgaatagctaaagcccgtgcaataccaactcgctgttgttgtccgccggaaagttggtgtggatagagattagctttgtctattagccctactttacataataacgtttccgcttcttggcgtacttcatcaggcttgcgttgttgtacttgaacgggtccttccatgatattttctaatgcggttttatgtggaaataaattatattgttggaataccatgcctgattttttgcgtagcggtaaaatgtttttgcgaatgtgtttatccgtaaaatcaatatacagcggattttctttgtgaaattcgattgtgccttgttccggtaattcaagggcatttaaacaacgtaaaaaagtcgttttacctgaacctgatggtcctaagatgacaacaacttgacctttttctatatctaaatcaattccacgtaatacaggattattgtcgaatgttttatgaatattacgaattttaatcatcatttatcctttgttagcgagtaacataacgagcaagttttttttctatgcgagcttgccataagaacaagacaaaacagaaacaccaataaatcagggctgcctcaatataaacgggtaggaaatcgtaagacatatttgctacttgttgtgccactcggaacatttccgttactgttactaccgaagctaatgaagtgtctttgaataaactgataaatgtattactcagaggcggaacggcaacacgaaatgcttgcggtacaataattcggcggaaagtttgcatataagtcatgccgattgtgtaaccggcttcccattgtcctttagggacggattgtatcgccgctcgtaccgtttcagaagcataagcaccgacatttaatgagaaaccgataattgcggcaggaataggatcaataaaaatccccagtgcaggtaatccataaaaaacgatggatatttgcaccagcattggtgtcccacgaataattgaaatataaatttttgttataaataaaaagaggcgatggataatgctatggctcggactcactcgaattaacgcaacagcaatcgcaataaccattcccaatataaatgatacgatagcaagcggtattgaaactaataccgccgctttgaccatgggaaaaaatccatttatgactaattctgctcttgcctcagtcataaaaggcaatgaggcaaggaaattatttaacactgatatctctaccaaagaattgttcacctaattgttttaatgtgccatcgttgcgtaattcttcgatagctgcactgatttttgctagtgcttcatcattatttttattgacaataagacccgcccccactttatcttcagattcccataccggttttaaacctgaatttgggtattttttcaaataatccaataaggctagtgcatcgttaaacgtcatatctgctcgtttttgttgtatgagtaataagccttgtgccatgccgtcaataggaacaatcttagcttggtatttttgtgccaattcaccatagtttgagctaagtgtttgtgctgcttttaagccttttacatcttcaacttgtttaatgcgagtttcattatctcgtgctactaacattgctccggaccaactataaggttcagatttgtcaaaagtggcttgacgttcaggtgttgttaatgcgacttggtttgctaccaaatcaaaacgtcctgcttttaaaccggcaagcatcgcatcccattgtgtttctttaaattcaacggttacacctaattttttagctactgcacgagtaacttcaacatcatatcccgtcaattttccggttgagtcatggtaagtgaaaggtgcgtaagttccttctgtaccgacagtaatcgttcctttgttgttaatgcgatctaataaactcgcttgagctgaggcttgtgtgttggcggctattgtcaaaacagcagtgaataaaaatgttatttttttcaacataaaagctcctttcagtaaaaattgggttgcggtaaaaaagagtgcttggcattgtaaaagaaatgttaaatattacaaataactttcgggaatatgttatgcagaatgggtgtttttatggagcgatgaaaaatgatcagaatttaacgcctaaagctcaagctgaaaaattaggaagcgagtaaaggaaaatcaagcgatatttcgttatggcacttgaaataatactgaataatagctatattacgacaaagggcgtaagctgccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaatgagctttgataagtgaattaggacttaaaaaagctcattttgttatatcgaaaaggtcaatgtagccagaataaataggcaaatgtaccgataaacagtacgcaaataatatttaagacaacacctgcacgaaccatttctttttgtttaatttcgcctgtaccaaagacaattgcattcggcggagttgcaaccggtaacatgaaggcacaagaggcacctaaaccaatgatcaatgctaaacctaattcaggcatgccaagtgaccgtgcaatagaaatgaagataggaactaataacgccgcacttgcactgtttgaggtaaattcagttaagaaaatgataaaggcggcaactaataaaccgataagatagaagttcccaccttcgatcatgaagactatgccgtcagccaaaactttgctcgcacctgagtcttgtaataccgcacttaatgttaaaccaccaccgaaaagcattaatacgccccaatccgtattatcttgtaactgtttccaagaaattacgccgctgacgcaaacggcaatagcggcaagtaatgcgatgacactgtcaaaactggcaatatttttttccaaccctaataaagatgacagcattgggttgagtttggcactaaatatccagcaaaatgcaatagttacgaaaataagtaatgtaatgatccgttgattattcatctcaactttctcaaagttttgtttgaaactcgccttgagattcggtttaaagataatgtaaagagtaccgatcatgattggcataagaataagcatgataggtaaaccgaaatagagccaatcggagaaagataatttcaattgagaagcaacaattgcgttgggcggactaccaatgacagttcccataccgccgatactcgcactgtaggcaatacctaataagacgaatacataagtgttatgttctttcgttctatctaattggctaagaatacccatagctaacggcaacatcatcgaagctgttgcagtattactcatccacatagaaagaaatgcggtaattgagaaaagataaatgacgccaataaagagatttccttttgccagcatcattattttattggcgatcattctatccaatttttgaatatgcagtgcggtagcgagggcaaatcctccaaagaaaaggaaaatagttggtgctgaataagaagctaaagcggtttttgttgtgactaagcctaatgcaattgctataaacggcaccaataaggctgttactgttacatgcagtgcttcagttagccataacacagcaataaagactaataaagccagtcctttatttgctttttcatcaaagggtaaaacataaagtagaacaaaaaaaacgataacatcaagaatgaatattaacgcattttggttaaaaattgatttagaaactgttttgctcataaggttatcctgcttagataaaatattgaactatccctattttggggtgggaatttgagtgaaagttaccaaatggtaaaaaaaatgcaacgaccttttgttttttttgtgaggtatgtctaaaaaataaaaagtgcggtcttttgaaccgcactttttgtaggaattagtgctgaatggtgattataagctatcaaactcttctaaatctaaaggctcttgagaaagaataatgccggtaagatctgcataaacatagtcatcaggaaagaaggttacgccaccaaaatttaccggaacgtccgtttctcctatgctttgttcatctgaaccgacagggataggtgcaagtgcttgaatgccgatatttatgttttctaattgttgtaattgacgaattgctccgtatacgataatcccttcccagccgttatctgccgctaattgtgctaagtttgcatcaattaatgcacggcgaaccgcaccgccaccatcaattaatagcactcgaccctcgccattttcttcgagaatttcactgattaatccattgttttcaaagcatttgattgtggtgattttcccaaagaacgtgcttttgccgccaaaactggaaaaaataggctcaacaacatcaatttgatcgaggtaaatatcacaaagttcagcagtatcaatatacatagggttttccttctatatttcggacagttgttaagtataaccaatattagtttacaagcaagctcaaactgaataatagattcgtgaacaaggcaagtaaggacatttgtgcaagcattgggcgtaaatgtaacggatttttattgcgatacacaaaatgtgcatgcttgatcagcagtggaaaagaaagaataaagataaaatttgaccaatgtgtaaatgtgtataaggcaaaaataatataacttaatgcactgagcaatagaataatgcaatgataaatacgtgcattttcagcacctaaacgtactgcaagggtatttttactcgcttttctatcttgttcaatatcacgtaaattattgatatttaataccgcagtagctaataagcctgttgcggtagcagggagaaaaataaaccaatttagctgatgggtttgcagataataagtaccgccaacaccgagcagaccgaaaaatataagtaccgaaacatcgcctaaacctaaataaccataaggttttgtacctacggtataagtaattgcggcaagaatggcgagtaaacccaaaagtgcaaaggcaacaagatcaacaattgtttgataagcattcacaatcagtaaactgccggaaatcaaactcaagaatacaacaagaataagtccctgttttaattgttttgcgttaatagcaccttgttgaatagcacgcaacggtccgatacgttcttgtgtatcggaacctttttgatgatctccataatcattggcaaagttggataaaatttgcaatagcaaggtcgttaataaacaaagtaaagttgttgtccaactgaactgttgtgaccaataagccaatgccgagccagtcataattgaggcggcagccaaaggtaaagttttgggtctagctgtttcaaaccacattttgacactattatttgccataatatccacattataattgatacagaaaatgaaattttcaccaagcgtgtaaatttgcgttattctactgttttattaatgagtttttaactgttttaaggaaaatatgtctaaatttttacttcatcttacgccgattgcaatcattcatacgccgtataaagaaaaattttccgtccctcggcaagcgaatttagttcaagacgggacaggtattgtggagttgcttccgccgtttaattgtccggaggctgtacgtggactggagcagttttctcatttgtggttaatttttcaatttgacaacgtgccgacaggtaaatggcaacctacagtacgacctccccgtttaggaggtaatgagcgtattggtgtttttgcttctagatcgacacatcgcccaaatcctttgggtttatctaaagtagaacttcgtgaaattgaatataaaaacggaaaggttttgttacatctcggctcggtagatttggttgacggcacaccaatttttgatattaaaccttatattgcctatgcggataatgaacctaatgcaagatcgggatttgcccaagaaaagccaaagcaggaattgcgagtggaatttagtcctgaggtgcaggcaacactggaaaaactggaaaaaaaacgaccgcacttgaagcgttttattcgagaagttattcagcaagatcccagacctgcctatcagaaaggaaaaaatttgcataaaatttatggtatggcactgtatgaatttaatgttcgttggagaattaaacatgatgatgttacagtggcggaagtgattcacattcagcatgtttgatcttcaaataaattttttgatccacttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcataaaatttatggtatggcactgtatgaatttaatgttcgttggagaattaaacatgatgatgatgttacagtggcggaagtgattcacattcagcatgtttgatcttcaaataaattttttgatccacttcacatttttacagttttcttttttctttttatgaaattttccattaaactactttttgtttaatcgaaacgtttcgatgataattatcaatgttttctctgaataatttcagaaaaatgggagaaaattaatatgaagaaaacaaaattattaaatgcgagcttatcacattatattgcaacgttaggccatacagacagtttggttatttgtgatgccggattgcctatttcaaatcaagttgaacgtattgatttagcgttggaggcaggcgttcccgcctttttacaaactgttgatgtggttataagtgagatgtttgtggagcatgctgttgtggcgaaagaaattagagaaaaaaatccgcaaattcatgacgcacttttagattcgttaagaaaattatcagaacaacaaggcaactgcattgccgttgaatatgtggaacatgaagaatttaaagtattaagttctgagagtaaagctgctgtacgtacaggggaattctcgccgtatgccaatattattttgtattcaggtgtgccgttttaatcagttgaagagaggtatttatgcaagtggaaaccttgctcaaaattaccggtgtagataaatcttttccgggtgttaaagcacttagtaatgcttgtttatctgtttatgcgggacgagcaatggcacttatgggagaaaatggtgcaggtaaatcaacgttaatgaaggttttaaccggaatttatagcaaagatagcggttctattgaatatttaggagatgttgtcaattttaaaggacctaaggattctgaaacggcaggaattagtattattcaccaagaactgaatttagttgcaaatttaaccgttgctgaaaatatttttttggggcgtgaatttacaacctcttggggagcaattgattggaagaaaatgtacagagaggctgataaattattagcacatttgggtgtgtcatttcgcagtgatcagctttgttcggaattgtctattggtgaacaacaaatggttgagatagcaaaagcgttgagctttaaatcaaaagtgatcattatggatgaaccgacagatgccttgacagatacggaaacggaaacgctttttaacgttattcgtgaattaaaagaacaacattgtggcattgtatatatttctcatcggatcaaagaaatttttgaaatttgcgatgatgtaacagtattacgtgatggacagtttattggtgaaagtgcggtgcgagatctcacggaagatcgtttaatcgagatgatggttggtcgctgtttagaggagcaatatccgcatgttgaacaagatcgtggttctgttcgtttggaagtaaatcagcttttcggtagcggaatatgtgatgtgagctttaaactatatagtggtgagattttaggtgtgtcaggcttaatgggtgctggtagaactgaattgatgaaagtgctatatggtgctttgcctaaagaaaaaggtgaagtgcggttaaataataaagtcatttctaataattctcctcaagacggtttaagaaacggtattgtatatatttctgaagatcgtaaaggcgacggactaattttgggtatgtctgtaaaagaaaatatgtctttgaccgccttggatcatttgtcaaaagccggaaaaattaatcatcaagcagaaaaaatggtggtagatgattttattgagttgttcaatattaaaaccccaaaccgtgaacagcaaataggcttgctttctggcggcaaccagcaaaaagtggcaattgctaaagggctaatgactcgtcctgatgtacttattttagatgaaccgaccagaggcgttgatgttggtgcgaaaaaagaaatctatcaattgattaataaatttaaacaagagggattaagtattattttggtttcatctgaaatgccggaagtacttgggatgagtgatcggattttagttatgcacgaaggtcgtattagtgctgaatttagtcgtgaagaggcaacacaaggaaaattacttgccgcagcactcgggaaacataattaagggaattgtatgaaatcatcatttaaattgggaaaaatgttattagagcaacgttcagttattgctttgttgatacttattgctattgtatcaatgattaatcctgactttttcagtattgataatattcttaatatcttacgtcaaacgtcgataaatgcgattattgcagtaggtatgacttttgtaattttgattgcagggattgatttatccgtcggttctattcttgcgttgaccggtgcggttgccgcttcattagttagcatggagttatccatttttatggttattccgttaacgctattattggggacttttttgggtagcgtaagcggttttatcgttgcaaaaggcaaagtacaggcatttattgccacattagttaccatgactttattacgtggtgtgactatggtttatactgaaggtcgtccgattagtacgggattttctgaaacggcagacagctttgcttacttaggtacaggttatttattgggtattcctttgccgatttggttaatggtaattgtatttgcggttgcttggtatgttttaaaacactgtaaaatcggacgctatatttatgctttaggcggtaatgaaaatgcaacgcagctatcaggcataaatgttaatagaattaaaatatttgtgtttgcagtgagcggctttttatccgcacttgccggattgatcgtcactgcacgtttatcttcagcacaaccgacagccggtgtgtcttatgaattagacgcgattgcagccgtcgttgtcggcggaaccagtttaatgggcggtaaaggtcgtgttatgggtacattaatcggtgcattgattatcggttttttaaataatgcactgaatttattagatgtttcatcttactatcaaatgatagcaaaagcgttggttatcttaattgcggtgcttgcggataactatttaggtaacaaaaaagcataaactcaatatctttataggagattttaaaatgaaaaaattaacaactattgcatcagctgtcatgttaagtcttgcttttagtggtgtagcaatggcaaaagagacaattgcattagcggtgtcaactttagataacccattctttgtgtcacttaaagacggtgcacagaaaaaagcggatgaattaggttataaattagtcgtgttagattcgcaaaatgatcctgcgaaagaactggctaatgttgaagatttaatggttcgtggtgcaaaagtattattgatcaacccgacagacagcgaagcggtttcaaatgcggttgctattgccaatcatcgtaatgttcctgtcattaccctagatcgtggagcggcaaaaggtaaggtagtgagccatatcgcttcagataacgtagccggcggtaaaatggcaggtgactttattgcacagaaattggggacaaatgccaaagttattcaacttgaaggtattgccggtacatctgcagcacgtgagcgtggcgagggtttcaaacaagctattgcagaacacaaatttgacgtattagccagtcagccggctgatttcgatcgtactaaaggcttaaacgttatggaaaatttattagcaagtaaatccgcagttcaagctgtatttgcacaaaatgatgaaatggcattgggagcgttacgtgctattaatgcggctaataaaaaagtactggtagtcggttttgatggcactgatgatggtgttaaagcagttaaaagcggtaaattaggtgcaactattgcacaacaaccggaacttatcggtagtttaggcgttgaaactgctgataaggtattgaaaggtgaaaccgtcgcagagaaaattcctgttgacttaaaagtcattgttaaataataaagtgaggacatatttattgtcctcatttcttgatataaacaataagggcgattttgtttattttctgataaggataaatgatgagtaaaactcttactgttcttggtagtattaatgcagatcatgttatttctgtaccgcactttgccaaaccgggcgaaacactaagtggtaaacaatatcatattgcttatggcggaaaaggtgcaaatcaagctgtggcagcagcaagattagcggattttagccaaggtgcaaaagtgaattttattggttgtatcggtgatgacgatattgggcaagcgatgaaaaaagcatttgcacaagatggtattaatgttgcaacgattactgaaatacctaatgaaatgaccggaattgcaatgattcaagtggctgatagcggagaaaacagtattgtcatttctgccggtgcaaatgcatatttaacgcctgagattgtagataaatttgcgacagaaattgagcgggcggattatttactcatgcaattggaaacaccgttgaacgcaattttggaagcagctaaattagctaagaaatatggtgcgacagtcgtattaaatcctgctcctgcgagccaattacctgatgaattgctcagtttattagatatgattacgccgaatgaaacagaaacggaaattttaaccggtgtgaaggtaaccgacgagcaaagtgcggcgaaagcagcgagtgttttgcatcaaaaaggtgttgctactgtgttgattacgttaggttcaaaaggtgtttatgtgagtcggaaatcttcgacacaagaactggggcaaaataaggttatagctggattcagagtaaatgctgtagatacaactgcagccggtgatacgtttaatggggcatttttgaccgcacttttagaaaataaatctcttgacgaagctattcgttttgcacatgcggcggcagcgattagtgtgacgcgtcaaggggcacaaccttccattccaactcgtcgagaaacattagactttttggcacaacattaattaatgtaagggcgttgaagatggctacaatgaaagatattgctcgaattgcacaggtatcaacgtccactgtttctcatgtgattaataattcacgttttgtcagtgaagaaattcggcagaaagtcatggcggtagtggagcaactgaattatacgccctcagcattggctcgcagtttgaaagtcaaagaaactaaaacaatcggcatgctggtaactacgagtgataatcctttttttgctgaggttgtggcgagtgttgaacgttattgtcgccaacatcattatcatttgatcttatgcaataccaatgatgacagtatttgtttgcaagaaaatctgcaaaatttgatacgcaagcaggtcgatggattgctcttgatgtgtacggatagtgcctttgaaaccagtcctttaaatttaactgttcctactgtcatcatggattggtggccgacagagctaagtgcggataaaatttttgaggattccgagctgggcggatatttggcgacacggactcttattgagcatcaacatcatgatattgcgattattacgggaaatctgaaaaagcctcttgctcgtaatcgtttgaaaggctataagcaagcgttgcaagaatacaacattcctattcgtgataaatggattattgaaagtcattttaactttgaaggcggaattaagggaatggaacagttgttacaattgaaacagcgtccaagtgcggtgtttgcttgtagtgataccattgcagtgggtgcttatcaagctgtttggcgtcatgggttatctgtgcctgaagatatttccattattggttacgataatattcatttagcacaatatctttctcctccactcagcaccgttcatcaacctaaagatgaattcgcacacttggcagtagatacattgttgcaacgaataaaaaatcctaccgaaagttaccgcacgttgacgttaaaacctgagatagtattgcgtcaatctatttgttcctgttttttgcctaagtccgcatagaaaaaagaccgcaagtgcggtctattatttatctccaaaatttccaccagcttgtgcgttttgcttccggaccttgaatgattgtattattgatatattctttttcaacatcaggtagcggtttatctaaattaacgtcggtgacaataccgcgtcgatcaaaattcacaataaaagtatgttgctcaggtgcattataagatttttgttgtaaaaatacgtagtaccaagtttgattgctaaatggatctattagcattggcgtaccaagtaagtactgaacttgttgtgcattcatgcccactttcacttgttctacagcggtagattctaaatagtttccttgtggaacatcaatacgataaacgattttttgaacactggaacaagcggtaacgcttaatcctaaaatcatagcaggaataataaattttaatcgcatattttgtttaccttaactcgtgcaaataacgtcgtggataataactaaaattcgtaaaattgccaacttattcttttgtttggcgttgtagttgatcgcgtaaattcggcggtagtcctgtaatggttaaactatccgttgcttcatcccaaaatatacggctgtttaataactcggcatcaaaacttaatgtgataccttttcctgagccggaaaatttagtcagcgattttaatgcagtacgtacgggaggaatattttcttctaagccataattttggctgacagcgaaatcaacaaaagactgttcatttagagtgggtatattggcagaaagttccctgacaacgatttcttcgcctacatttatttgtcctttacaataatcgaatacttgttttttgaccgcttgagtttgttcttttgtcaaatccgcctgttggcagtagtcactaactgcttgtaataaacattgattttgtgcttgaggatttaatccctcttctgcacctaaaaaatccataaaaaagtcagcaattttgcgtccaactcgacctttaataaaagtcagataacgagttgattttgcatctaaatgcaattcggttaaattaattcggcaagcaatatcaaattgagtaatatcaagataatgcgtttgttttatttccagattttcatcaaccaacatactataacggctatctaataatgcgatgaataaataatctgttgcgagaaaattgtattgacacaaaattaacgtgccatcattggcaaaactgtattttcccaactcttgacgtaataattctgctgattgatgactaaatgccaagaaatcaatatcgttttccaatgtgcggttgagtatttgagcaaaatttgaggtttcttggaatactccataggcttttgttttattttgatactcttgatgtaattgcaacatcatttgttctgtttccgctgtaattggtaataattcatcacgtaagtgcgtttttagttgaacggtattttcatcttgtgatgttttaaccaattgatgcaaaacaatttgattaactataatgctcattttgttcaaatcctgtttatgataaaaattcttaatattataaccgcactttaaggaaaatatgctagtatgtgtccaaattattcgtttctatttatatttagcgtacaaaattaaatggcaaaaatttcaaaatttcaagataaacaagttgaggcaatattgaatgatatgatcgctgtactggaaaagcatcaagctccggtagatctttctttagtcgtattgggcaatatggtaacccatttgttaaacagtagtgttgggtcgcaacaacgtattgtgttggcaaaagtattttccgatgctttaatgaattcagtaaaaaatagtaaataatatgtttggaattaaaacaagcaagcaatatcgtgatgaattatctcgtaagattacgtggggacattggtttgctttttttaatattttgtgggcaattgttattggtagtcgttatgcctttattattgattggccgcatactttattcggtaaaatatatttttttattagtttattggggcatttcagcttcattgtttttgctctctatttgctcgctctctttcctctcagttttattataaaaaatgaacgcacttttcgtggtataagcgttattttaacaacgataggtgcaaccttactgttggttgatacagaggtgttttctcgttttaatttacatctttcaaccctcgtttggaatttgttggttaatcctgatgatggtaagttatcttataagtggcaaatattttttgcacctatgccattgattttatttgttcaaatgcttttctcacgttgggcatggtataaattacgcagtttagagagacaaaaatggattaaaggtgttgctcttgtatttgttgttagctttattgctacacatattctttatgcttgggcagatgcgtatatttatcgcccgattaccatgcaaaaatcgaatttccctctatcttatccaatgacagcacgttcatttctcgaaaaacatggtttcttaaataagtctgaatatgaaaaaaccttaaatgagcaaggtcgtcttgatgcgttaaaagtgaattatccaaagcagaaattgactttttccgatgagttgccaaagacgaatattgtccttatcactattagtggattacgccatgatgcagttcgacaggatataatgcctaatttatttgcattttctgagaattcaactgaatttactcatcattacagttcaggaaactctcttaatcaaggtttgacaggattgttttatggattgaatgctaattatgcggacagcttacttagcaataaaacaacacctgtattaattgagcaattgaaacaaggaaaagtgcggtatgaaattgggttattcggtcagaatttatcccgaagtgcgttattgaagaaaagtatttttgcgaatgagaaaataagaaatgacagcaacgcatttacccagcgttttattgagtttgttaatactcgacaacaacagcaaaaattattttttgcctatctaaattattcactgaacagcaatttgactattgaacaatattatcaaaagttatctgaaattgatgatgagattggttcggcatttaagtcgatagattttactcataccattgtgatagtgacttccgaatatggttatagttttgatttttctgataaaaaaagaccaactaattattttgcaagagaagtaattcaagttccaatgattataagatgggaaaatttacctatcggtaaagtgaataaattgagtagtcataccgatttggtcccagccttaatgaaacatatttttaaagtaaaaaatccaattagcgatttttctcaggggcaggatttatttgatttggatgataatcgtagttgggttcttgccggtaattaccggtggaatgtgatcattacaccggatgattcgcaatatcatattgataggaatgggcattatcaaaaatacaatcaacattatcaaaaaatttcgtcaacacaacctccgttaggattattcttagaagtattttcacagaatacggctttcatcgaaaaatagatttattagaggtaagccgtttttcgagatgagaatgctaagagtggaagcgtattctgttttataaaaaaaagcgtttcttttgtgggggaagaaacgctgaaatgttggagtgattatctattattgtttgagtgatatagatgataattgttctcaaatagcttgtcaataaataaataaaaattattatcaattttttttcttgtctttaattattctaggtaattcactaaatttgttagataaagtgcggtcggtttttgatgagaaaaatcaaattttacagcatagctataaacttcaacaccttctttaactgcttgctgcagtaattcggcataatcaggatcaatagattttgcaacagtgaagcgattaaaaccgtcgtgaagaccggcgaaaaaaacgaccgctctatgtccccgctttttcattgctataagctcacgcaagtgtttttgtcctcttgttgtgacggcatcagggaacaaaccgagatgatttttgacaaacgtaacggattttacttcgacataacaatcaggtaagtttttacctttgagtaaaaaatcaatgcgactattttctacaccatattttacttcaggcaaaatctcatcatattcagctaattctgtgatgattttattttgcaaagcttccaacgttaattgattggaacggtgagtattgatacataccgtttgaccgtttttgagttgggttaattcccaagagtgcggatattttctcgttttgctgtcagaagtagaaaaccagactgtatcgcctttttcaccacatcctgtcattgcaccggtattggcacaatgaagcgttaaaatttcaccgttgtttaattctacatctgccaaaaagcgtttataacggcgaagtaatgttgctgattgtaaattcggtaattgcataaaaatccttgttatccaacagttttagtaattttaccagctttatctgaaaaaaattttgattgaagcgatagttgaaatttttaagaaaatagctttatttttagcgaattagtggtacatttactccgcttgactttttgtcatcttaaaggatgggcgatattatctcccaatttttttaatcaatcaatttgaaggaaacattatgttaattggtgtacctagagaactgcttgataatgaaagtcgtgtggcggcaacgccaaaaacggttcaacaaattttgaaacttggttttgaagtgattgttgagaacaatgccggttttaatgcgagttttgaagatcaggcgtttgtaaatgcaggcgcaaaaattggttcggcacaagatatttggaatgcggatattatttttaaagtaaatgcaccgacagatgctgaaattgcacaaattaaagaaggtgcaacgcttattagctttatttggcctgctcaaaattcagagctaatggcaaaactttctgctaagaaaattaatgtgttagcaatggatgctgtgcctcgcatttctcgtgctcaagccttagatgcgttaagttcaatggcaaatatttccgggtatcgtgctgttattgaagctgcacatgaatttggtagctttttcacagggcaaattacagctgcaggtaaagtacctcctgcgaaagtacttgttattggtgcaggggttgcagggcttgcagcaatcggtgcagctaatagtttaggtgcgattgttcgtgcatttgattcccgtccggaagtaaaagaacaagtgaaatcaatgggagcggacttccttgaaatagatttccaagaagagggcggtagcggtgacggttacgcaaaagtcatgtcagaagaatttaatcgtcgagcgatggcactttatgcggaacaagcaaaagaagtggatattattattaccacagcagcgattccgggtaaaccggcaccacgcttgattactaaagaaatggtggattccatgaaaccgggtagtgtaattgtggatcttgctgcactgacaggcggaaattgtgattatacgaaagccggtgaaattgtggtaactgaaaatcaggtgaaagtcattggatatacagattttccaagtcgcttaccgacgcaatcctctcaactttacggcacaaacttggttaatttattaaaacttttatgcaaagaaaaagatggcaatatccatattgacttcgaagatgtggtattgcgtggtgtaaccgtaattcgtgatggcgagattacttggccggctccgccgattcaagtttctgcacaaccgcaacaaaaaacaaccgcacctgttgcggataaaaaagaaaaaacgccgacgaaccctaaagtgaaatatggggcaatggcattggcaggagcggtcttcttatggcttggttctgttatgccggctgcatttttatcgcactttactgtgttcgtattggcttgtgtagtcggatattacgttgtatggaatgtaagtcatgcgttacatacaccattaatggcagttactaatgcaatctcgggaattatcattgtgggggcattattgcaaattgcacaaggaaatttctttatcagtttgttggcgttcattgctattttggttgcggcaattaatatttttggtggctttaaagtgactcaacgtatgcttgccatgtttagaaaaggttaaggagaggatgcaatgtctgaaggtttagtacaggctgcctatattgttgcagcattactgttcattatgagtttagcaggtctttctaaacatgaaactgctaaagccggttgttggtatggcattgttggtatggcaattgctcttgttgctaccatttttggaccatattcacaaggattattctggattattattgcaatggcagtcggagccgtcattggtattcaacgtgcaatgaaggttgaaatgaccgaaatgccggaattggttgcaattttacatagttttgttggtttggcggctgtattggtcggttttaatagtttcggtttgcatgaaaccgcacaatttttggtaccggaaggtgttgaatatgtcatggacgctgctcaagcattattagcacaacaaaaagcggactttgttgcggaacaatctgtattggcaactattcacaatgttgaggtctttttaggtatcttcattggtgcggtaacatttaccggttctattgtcgcattcggtaaattacgcggtattattaattctaaagcgttaatgttgcctcatcgccataaattgaatttggcggcattgattatttctgcgttgttgatggtcgcatttttaaattcacctgataatatcttccctgtattactaatgacagcgattgcacttgcatttggttggcatcttgttgcttcaataggcggtgcagatatgccggttgtcgtatccatgttgaactcttattcaggttgggcggctgcggcggcaggcttcatgttaaataatgatttgctcatcgttaccggtgcattagtaggttcatcaggggcaattttgtcatacattatgtgtaaagcaatgaaccgctcttttatcagtgtcattgccggtggattcggtaatgatgtagttgcttcatcagaggcagaacaaggtgaacatcgtgaaacaacagccgaagaagtggcggaaatgttgaaaaatgcaagttctgttattattacaccgggatatggtatggcagtggctcaagcacaatatccggttgcggaaattacagcaaaattgcgtgaacgtggtgtgaatgttcgctttggtattcaccctgtagccggaagattgccagggcatatgaacgtattgcttgcagaagcgaaagtgccttatgatgttgtacttgaaatggatgaaatcaatgaagattttgcggataccgatgtcgtattagtcattggtgcaaatgatacagtgaaccctgccgccatggatgatccgaatagtccaattgcaggcatgcctgttctggaagtttggaaagcggctaatgttgtcgtattcaaacgctctatggcggtaggatatgctggtgtacaaaatccgttgttctttaaagaaaatacccaaatgctttttggtgatgcaaaagagcgagtagaagatattttgaaagcgttataacaagagaaaaactggtatagaatataactgcactttgctaaaataaagtgcagttatttttttacatttaggaatatgttatggtgcaatatgccttgctcattttgtttagccttgcttcaataatttttattattaactcccattatcgttggacatatttttttgcaataagtcaatttttgttatttattggcattatgtttactattacagggcaatggcaaagagcggttaatttttcttctacattattcattgtttttgtgttgtttcatcgaattaaaatccatttttataagcaaccgcttttgatttcagatttctttttagtcatagattggcgaaattgggaaaccttgttgcattatcgtcaggctttttttgctattatggggctattggttttgttggcttatggtatattcggttggcaaaatacccccgctcttcctttttattggcagataatatcaggcttaatttctattattttaattgtttcaatttgtcactgtacaaagaataagcaagctatcaagcaatggttagattctttacctgatgatggaagagatgtatttcttaatttacctatgtcctgtcgaggaatcttttataaatcgccggtattttctggaggtagtcaatattttcttgaaaaagcagaatcaattgaaagccataaacaatcaaattcggagcaaaaagcagatattgtagtttggttacaagaatcaacgttaaatccgcatagttttctttttaaacagcacaatattccacctatcacaatgtatgaaaatcaagatgatacaaaatgtaattctcatctgcgagtacataccttaggtggtgcaacttggaaatcagaatttgcatttttatcaggattgccctcaacagatttcggtgcaatggcaaatgcagtattttattctgtcgttcctcatctaaaatacagttttgttaaaaatttaaaagcacaaggatattattgtgttgctttgtcgccttttacgaaaggaaactataatgcgaaatctgcttatgatcattttggttttgatttaatgttacaaccgcaagatttaggctatccggctcccatgggtaaaaatctatggacaatcggtagtgatgaaatgagtcagtatgttcagaaaattcttgataaaaaagatgtgcctcaactaaaagatttacaaaaacccttatttgtttatgtattaacaatgcgtgaacatggtccttattacaactgcggtaatatttttcaaattcaaatggattgtgcaacggagcgagggatcggggaattaaatgattatattcaacggattgtaaatttgaatcaagttatggaagattttaatctttatatgcaacggagaaataagccttatattttaggttattttggcgatcatcaaatttcaataaaagaagctgtaccaagttacagttttaattatccttatccggaatatatcacgcaatttgcggttcgcagtaatttagaaacggattttgaaaagcacgattttttagatttagcatttatagcaggagctattttagaaatagcgggattgcctgtcgatgaatttatgcaaacaaatattaaaatgagaaaattaagtggaggtaagttacaggactgtactgatcaacaattattagagtcttatcgccattatatttattcagaattaaaagtagcggagtagttcattatgaatatgttgcctaattaaaggcgttgctattaaaaggtgtaatgaaaaatggttgctaataatatctttctgaagttattagcaactctttttatttaaaagtccttattgacgtcctcccctagctaaagcaaggagattcctaccagctcccattgcaagcaatgggctactctcggaggtttctgctgctgaccgccaatgcgattcacttcacagacgctacgggcacgtcctgccctgattatgccgtcattgagagtctaaagcgacctctgttagcagtaagaagtatatcatatttgtgccttatatctacgccctaaaggacgtggttttacggcactgtctgataaaaactattttttcttcgcatatttcaaggaatcaattgcaacggcaaagataataattgaacctttgataatatattgccaatatggatttacaccaatataggttaaaccatagttgatgacagtaaaaattaatacaccggttactacgcctagtacagtaccaacaccgcctgcaaaagatacaccgcctacaacgcaagctgcaatggcatcaagttcatacataaaacctagattgttggtggcagaaccgatacgtcccgcttctaacatccccccgaaagcgtagaatatacctgcaatcatgtaaatgacgacaaggttacgagtaacgttaacacccgatacttttgctgcttccggattaccaccgatagcgaaaatgtttttaccgaaacgtgttttattccatagtacccatacaaaaaaagaagccaaagctgcatagattgtaatataggaaagcttgaaagaacctatacggaaaaagccttgagcaaatgtagagaaactttcgttgaaccctgcaataggtgaagaaccgacagcatcataatagagagagttaataccgtaaacgataatcatcgttcccatcgtggcgatgaaaggtgtgacatttaagaacgcaattacaaccccatttaccaatccaattattgccccaatcatacagactactatgattacaacaggaataggaatttcaccaagttcagggaaaactctatttatattatccattgcttgtaacagagttgccgaaataactgcagctagaccgacttgacgacccgctgacaagtctgttccttgtgtaactaataaacctgcaacgcctaaggcaataattaagcgaacggaggattgcgttaaaatattactaaagtttcttaaacttaagaaacttgagtcttgcataataataattccgagtaagatcaataacacaaaataaattgcgttttgtttaaggaaatctagcgatttgttttgttttaaagcagacataattcatttccttcctttaaagatattttgccgcaagttgtaaaatttcttcttgcgatgtttttgctgtttcaacaatttcagtaacttttccgttactcataactaaaatacggtctgtcactcccaataattccggcatttctgaggaaattagaatgatccctttatctttttttgccaattccatgattagctgataaatctcgtattttgcaccaatatcaatgcctcgagtcggttcatcaagcatcaaaatttcaggttgtgtgagcaaccaacgcccaataattactttttgctgatttcctccagaaagtgagccaatatgggtttgatgtgaaggggttttgacattcattgcatcaataacccattgggtatcacttttcattttaatggactttaataaaccaaaatgacctaaataggatttcatattagaaatgagagagttaaattctatgctcagatttgcataaatacctgttgagcgacgttcttcggtaacgagagcaaatccattattaatcgcctcaagtgcggtgcgatttttcatttctttgttatacaatttaattgttccacttttacgctcacgaataccgaaaatggtttctacaatatccgtacgtttggcaccaacaagtccagcaataccaagaatttcacctttacgcaattcaaaagaaacatcttgaatggagggttgatttaatgctgtcagatttttgacttcgagaataacttctttgggttgatttgttttaggggggaagcgttgagttagttctcttcccaccatcatggaaactatttcatccatggtagttttttgtacttcaacagtattaatccatttaccgtcacgcaaaattgtgatttcatcacaaattttgaaaatttcatccattttgtgtgaaatataaacgattccacagccacgtttttttagttttgcaatgattttgaataaatgttcaacttctttttctgaaagtgaggaggttggttcatccataatcacaattttggcattgtaggaaaaggcttttgcaatttcaaccatctgcatttgtgatacagataaattcgctactttctctttgggatcaatatcaatacctaactcatcaaaaatagcttttgtatctcgatacatttttccgtgatcaacaaaaatgcctttcaatggataacgtcctagccataggttatccatcacattacgttgacgcaccaaatttaattcttggtgaaccatggatataccgttttccaacgcctcttttgaggttttgaaattaattggcttgtttaaaaaaagaatatcgccttcatctttagcataaataccgaataagcatttcaacagtgttgatttaccagctccattttctcccattaacgcatggactgagtgagatcgaattgttaaattcgctttatcaagtgcttttacgccgggaaaggatttactgacatttatcattgtaagcagtatttcgccacttttatgcagagtttgtcctgtcatatccaacctcatagaaaaggggagcatagatctcccctaatgattataacaattattttaagaattcatttaagttgtctttatcgatgccgacataaggaatacgaacaacacgtttttctaatttccattttgttccttctgttgcaggtttattttgtgctaaattttttgcaagttgaaccacagctttaccttggttaacaccatcatttagtacagtacctgccatttcaccttttttaattaactgtaatacttccggcaaggcatcgacaccgaaaatcggcagttttttcccatgagctttagtagcttccaatgcacccatagccataccgtcattattagaaataatgacttcaatttcatttgccttggaactggataaccaagcatctactttatcttttgccattgcagcatcccacataccggtatcaataaataattgttctgattgaataccttgagcattcagtgcttcaattacatattttgtacgggcttcagcatcaggatgacctggttcacctttcaataacacatattgaatttttccatctttatttaagtcataggctggatttgctttccaatgtttcgcaattaaattaccttgaatgagtccggattctttaggatccgtaccgacatagtaagcgtggttatagcttccaattgcttttgctccgggatctttattgaagaagataactggaatatcctccgattttgcttttttaatgacagttggtgcagcggcagggtcaacaaggtttattgctaatgttttaatgcccttggaaattaatacatcaacctgatcattttgaacagattgtgcattttgtgaatcattcattaacaactctaatccacctacagcttttgcttctttatcgatttcttgacgcattaacgccataaaattatcgtcgtatttgtaaatggttacaccgatacgatcagctgattgtgctgagattgcactaaaacctacagctaaagttaccgcacttaatattgtttttttcataaaatgctccttgattggactggaaaatagatattcttatcgatacttagcctatggtttggcaagccacgacaaggatagccgaaaatgtgtgacaagactgtgatctgtttcacatttatagaaatttatgaaaacgatttcataaaataggaaaattaaggacgttcaactgaaaagcgtcgaactaaagttggattaaattggatatgaacaggttcatcaatttgattgtctactagacttagtgcgagttttgccgcataagttgccattaaatcaataggatagcgtacagtagtcaacttaggaattaaatagcgtgaaatgggcatatcatcaaatccaataatagagaattgtttaggaacttgtatattattttcgttcaatacggaaatagcaccagcagccatactgtcgttatacgcaataactgcggttaaatttgagttataactcaataaattaatcatcgcattttcacctccttcaaaatcaggtgtgctacgtgcaattgcatgttcaacagcgtgaagtttatgatgctctaatgctttcaaatagccattaaaacgatcattttcatctgtaatttgatgatttgagccaatataaccaatatgctgatgcccaaatttgatcagcatttctgtagccagaaaggtacctttattattgtctaaacttacacaacgagtttcataaccttgaatgacacggttgatgattaccataccggaaatacgttctaaatattgagcaagctcttgatcacttaaagcttttgaatgaacaactgcatcgtttgcacaataaggtgtctattgcatttctttctttttccgcattgtgatagccaatgccgattaagatacttttttcatgttcttccgcaacgttatctacggctttaactaaaattgcaaagaaaggatcggttacatcagtaacaacaacgccgatagtatctgtatgttgtaaggcaagagcttgagcattggcatttggatgataatttaatttttcgaccgcactttgaaccgctaggcgtgcttttttactggcagaaggatgattattgagtacccgagaaactgtcgcaacagaaactcccgcttgtctagctacgtcatgaattgtaatcatcttattcacccatacggtttaaaatttgcatgaattgccacttatcataaccaaataaattatgtttggaaacggttgttaaactaaaataaaagcgacttcacaaaattattatttatctcaatatttataatttaataattgtgatatggatcacagttaaacaaaatagcgatgtgatagcatagctgaaaattatttgtaatcgtttacatttttgcgataaatatcaagtttgagggtataaaagtgagtgaaatgaccgaatttgttgcgacagaacatccgcatcgtcgttataatcctttgacggaacaatgggttttagtctctccgcatcgagctaagcgaccttggcagggacaacaggaaaaaatagctgatgaaaataaaccttgttacgattccgcttgttatctttgtccggggaataagcgtattaccggtgagcaaaatccgaattatacgaaaccttttgtgtttaaaaatgatttttccgctttattggaagatactcctgaaccactaaaaacggatgaccctttatttcaatccagtctagcacgtggcgaaagcagggtagtttgtttttctccggatcatagtaagacgttgccgttattaacggtagaggaaatttttgcagtggtaaaagtttggcaagaacagctggaggagcttggtaaaaaatatcaatgggtacaaatttttgagaataaaggtgcggttatgggctgctctaatccgcatccacatggacaaatttgggcaaatagttttttgcctaatgaagttgctcggacagacaaggcacaacgaaattacttcaataaacaaggttcggttttgttaatggattaccaaaaacgtgaacgagatttgcaggaaagagtagtaattgaaacggaatattgggttgcagttgtgccttattgggcggtttggccatttgaaatattgttactacccaaaattcacgtgaagcgattaactgatctgaatgagacgcaggcaaaggatcttgccttggcattaaaaatgatcacaaccaaatatgataatttgtttgaaacttcttttccttattctatggggttccattttgcaccttttaatggtgaaaagaatgaacattggcaacttcatgcacatttttatccacctctgttacgttcggcaacagtgcgtaaatttatggtcggctatgaaatgttaggggaaagccagcgagatttaaccgctgaacaggcagcggcaagattgcgtgaattaggtgatattcattataaaaataaataaatttgacggagtgataatatgactcaacaaaatctaaagcaacgagcgaaacaattatttagtgaaaaatttaaccgcacttctgaactgaatgtctatgcccccggacgagtaaatattattggtgaacacacggattataatgatggatttgtgatgccttgtgcaattaattatggaacggcgatcagcggagcaaaacgagatgatcatttattttgtgtatatgcggcagatttacaagaatatgatgaatttgatttaagtcgacctattgaacctaaaatgggcacgaaatggacgggctatgttcggggggtagtgaaatttattcaactacattgtccgaattttcaacaaggtgcggatctagttatttgtggaaatatcccactttcagccggattaagttcttctgcatctttagaaattgctgtaggtaaattttgtcagcaactagcggatttatctttaacaaatatagaaattgcattaataggtcagcaggcagagaataaatttgtaggtgcaaattgtggaaatatggatcaattaatttctgcattgggtcaaaaagatcattttctcatgattgactgtcgatctttagatattgttgccatacctgttcctgaaaatattgttgtgatgattgtgaattctcatgtgaaacatgatttagtaaatggcgaatataatatacgccgtcgacaatgtgaaatggcagcccaattttttggcgtgaaagccttacgtgatgtatctgtggagttgttcaaacaaaaggaagcagaattaaccgctcttgatcctgaaatagcgaaacgtgccaaacatgttgtgacggaaaatgagcgggttttacaatcagttcaggccttacaacagggagattttcaaaaattaggggaattaatgtatcaatctcatgattccatgcgagatgattttgaaattactgtgcctgaaattgattatttagtggagttggcacaggtcgttatcggcaaaaatggtggagcacgcatgaccggcggaggttttggcggttgtatcgtcgctattgcaccgcaagacaaagtggaggcagtacgtcaaattattgcagacaactatgaaaaacaaacagggttgaaagaagatttttatgtttgtacagcttctaaaggagtgacgatatgctaattgattgttttgagaaggaacacaagcaaggaatggcaccggatggacaaccttttcgtatttttacgttaactaatacaaaaggcatgaaagtgcaagtgatggattggggggcaacttggatttcttgtcaagtaccggtaggaaaagaagtacgagaagttttgcttgggtgtcagattaatgattatccgatacaacaggtttatttaggagcgagtattgggcgttatgcaaatcgtattgcaaatagccgatttgagttgaatggtaaacgctatttacttaacgctaatcaacatcagcatcaacttcatggtggaaaagggtttcataatgagcgttggtatttagaaaagtgcggtgtaaattccatcactttttctcattttagccctgatggagatcagggatttcccggtaatttacatgcttttgttacttattctttaagtgaaaccaacaacgtgagaattgaatatgaggcaatttgtgatcaagattgcccaattaatttgactaaccatgcttattttaacttgaatgatgctactttcggttgtgatattcgagggcattctttacaacttaatagcgattattttttgccggtggacagtgcgggtattcctaatgctaagttaaaagcggttgagggaactagttttgattttcgtgaggaaaaaccaatcggtttagattttttacaagaagaacaaaaattggtaaaaggttacgaccattctttcttgcttaatccggacattgaaaaaccttgtgctattttgaccgcacttgatcgttctttgagaatgcaagtgttgacttctcagccggctttacagatttatacgggcaattttctatcagctacgccaactcgccaaaacgggcagtatgctgattatgctggtattgctttggaaactcaatgtttgcctgatacaccgaatcatccggaatggtggaaatatggtggaataacaaaggtgggtgaaaaatattctcataaaacggaatatcaatttatccgttagatttttaagcaaactctattgaaattaagggggagtattcaaaaaactcccttatttttttctatttctcgcttatatttttgttatgtcatacttttcctgatttttcctagttattcgttacaaaatatgataattttcatgggtcaataagacggaaacaatattacagtttatgagtaacgacgaacagattaatacaatcacagaaaatgaaagtaagaaaaatttctttcactctttatttggacgcttttttcagggtgaattgaaaaatcgtcaagaattagtagacgttatccgagattctgaacaaaatgagctcattgatcaaaatacacgtgaaatgattgaaggtgttatcgaaatctcagaattaagagttcgagatattatgatcccacgttcacagattatttttatcgaaaatgatcaggatcttgaagcgtgtcttgatgttattattgcaagtgcacattctcgtttcccagttatcagtgatgagagagataatattgccggtattttacatgcaaaagatttacttaaattttttcggtctaatgcggagcaattcgaattacaaagtttattacgacctgccgttattgtaccggaaagtaagcgtgtggatcgaatgttaaaagattttcgtgctgaacgttttcatatggcactagttgttgatgaattcggtgcgatttcaggtttagttaccatagaagatattttggaacaaatagtgggggatattgaagatgaatttgatgaggaagatgtggcggatattcgtcagttatctcgtcatacttatgtagtacgagctttgacggatattgatgattttaatgagcaatttaagaccaattttgccgatgaagaagtggatactatcggaggtttgattatgcaagcattcggctatttaccgaaacgtggtgaagaagttgtactggataatttgaattttaaagttacttcggcagatagtcgtcgcattattcaagtacgagttactgtgcctgatgaacaacttatagacagtaaaaaacagaataaagaagaatgaaaaattaccttgtttatttcattgctattttaactgggggagtgggcgtattagccttttccccttttgatctttgggcaatcgcctatctttcattagctgggttgatttgggttgctaaaaaatcgcaaaaaaagaccgcacttctagccagttttttatggggtttaagtttctttgggattggcgttaattggctcaatgtcagtatttatcaatttggcggaacaccgttaattgtgagttatttactggtcattttactggcaggatatttggcactttatcctgtgttgtttacttatttagtacaacgttttagggtacaaagtttagcgatatttcctgcaatttggacattgactgaatccttacgcagttgggtatttactggttttccttggctacaatttggctatactcaacttgacagcccatttgcgaacttagccgctttgttcggtgtagaagggctgacttttttcgtgatgtggataagtgcggtcatttttagtcttatttctcagctcatacaatcaaagaaacaatgggcaattattattacacatagtgtattgcttgttgtgatgttagggctaagtgcatccactgcgttacttaaatttacacaagaaaatccacaaaaatccctaaatgttactttagtgcaaggaaatattgaacagcaactaaaatgggatcctgattatttttatcaaacactcactatttaccaacgcttaattaaccggagtttagatgactcagatttaattatattgccggaagctgccttgccggccttggaaaatcacattcaaccttatttgcaaaccttacagcaacttgctcaagaaaaaggcgttgaggttgtaattggaacgatttatcaagaggaaagtgaggataaattattaaattctatcgtaaatctcggtaacgctgatgaaccttatcatctaaacacaaaaaaccgttatgcaaaacaccatttagttccttttggagaatatgtccctttagacaaaatattacgcccgttaggttcagtttttaacttgcctatgtcaagttttgcgtcaggagactttgtccaaaaaccatttttagcgaaaaatcgccattttactccggcaatttgctatgaaattatttttggttctcaactacaacaaaatttaactaagcaaagtgattttattttaactatctcaaatgatgcttggtttggcgatagtataggcccttggcaacacttgcaaatggcaagaatgagggcgattgaactgggaagacctgttattcgtgcaactaatactggtattacagcctttattgatgcacaaggtaaaatagttgcacaagctccgcaatttactgaaacgacactgagacataaaatcgttgcaacggaaggcatgactccctatgcaatattaggaactaagccgttgtatttgttaatcagtttattagtattatttagaagtctaggtgcattgatacgcaaaaaattgacgcaaggatagaaaaatattattttgcgaacaggttacagctatttttccagattgtagatgcgataagttctgccggttcttttcttaattgacataattcatggaaaacatgaataattcgctctgaacgattgggttgaccttgaaaaccacaaatgggcatatcgggactatccgtttccagtaataaactgtctaaaggtaattttgcaatagtatttctggttttattggcacgttcataggtgattgtgccgccaacaccgattttatagcctaaatccacaaaacgctttgcttgatcataacttccggcaaaaccatgaattacaccgcacttatttacttttattcgtttcagaaaagtgaataagtggtcgtgagattggcgactgtgcaagctgacaggcaaattaaagcgttgtgcaaaactgagttgaacttctagaaattcacattgctttttccataatctctcgctaatcagatcagattttcctcgttccaaacctatttcagcaattgctgtacaagcagcagaaccttgttctaacgcttgggacaaaatatctaaatcatttttactatgctgttcaatatataaaggatgtaagcctaatccataatacagctgagtcgggtaaagtgcggtcatgtttacaatattttcaaaatcttgctgcaatactgcaacaatcagcattttctctaccccaattcggtgagcattatgtatgagttgagctaagttttcctgagtaacttgctgtacataatctaggtgtatatgagtatcgaaaaaacgcataatgatttgatgatagcaacttgaggaacaatattggctacattacgacgaaatccttgatcgactttttgttgaatgatcaaggaaatcgttatctacaagatgggtaaaaattgtaatatgcttgaatgtaacaccgcacttttggatgaaaatgtaccgacaatatttgtcgggccactatcaaaaatattattcaatggtaacagaagtaataattacatcttcaacaggcacatcttgatggaaacttttgtttcctgttttgacacctttaattttatcgacaatatccattccttcaacgacttcaccaaatacagcatagccccattcttgcacaacggttttaccaaacatttcttttgctcgataatcaaggaatgtgttgtctgctacattgatgaaaaattgagctgtcgccgaatgaggatccgatgttcttgccatggcaattgtgccacgtttattgctaagtccattacttgcttcgtttttaattggtgctttagtatttttttcacgcaagccactttccataccaccaccttggatcataaatccatcaataacacggtggaaaattgtgttattatagaaaccctctttgcaatatgttagaaagttttccgctgtaattggtgctttttcaaaatttaatgctaatttaatatcaccaaaatttgtgtgtaatgtaatcattttagatcctttgattttgtgttgttataatgatgcttattatttcataaagttgcaataagtgctataaaatcatcactgagcggattcagcgttctggtagattaacgatttcatttaattatagagaacaaacaaatgttaaaaatttttaataccctaacacgagaaaaagaagtgtttaaacctatttcagaaaataaagtaggaatgtatgtctgtggtgtaactgtatatgatttgtgtcatattggacatggacgcacttttgtttgttttgatgttatcgcacgttatttacgttatttgggttatgaattgacttatgtgcgtaatattactgatgttgatgacaaaattattcgccgtgctttagaaaataaagaaacttgcgagcaattggtagatcgtatggttgttgaaatgtataaggattttgatgcgttgaatgtattacgtccggattttgagcctagagcaacacaccatattgcagaaattattgcactggttgaaaaattaattgcacgtggtcatgcttatgtggcggataatggtgatgttatgtttgacgtggaaagtttcaaagagtatggcaaattatctcgtcaagatttaacacaattgcaagcgggagcaagggttgaaatttctgaaattaagaaaaatccaatggatttcgtgttatggaagatgtcgaaagaaaacgaacccagctggaattcgccatggggagccggtcgccccggttggcatatagaatgttccgcaatgaattgtaaacacttaggtgagcattttgatattcatggcggtggatctgacttaatgtttcctcatcatgaaaatgaaatcgcacaatcttgttgtgcacatggaaaccggtatgtaaattactggatacattcaggtatgatcatggtggacaaagagaaaatgtctaaatcgttgggcaacttttttactattcgtgatgtgttaaaccattatgatgcggaaagtgtccgttatttcttgttgacagcccattatcgtagccaattgaattatagtgaagaaaatttggatttggcacatggtgcattggagcggctatacactgctttgcgtggcacagataaaagtgcggttgctttcggaggggaaaatttcattgctcagtttactgaagctatgaacgatgattttaatacgccgaatgctatttctgttttatttgaaatggctcgtgaaattaatcgattaaaaaatgaagataaactgcttgccgatggcttggcggctcgtttgagagaattagccggtattctaggtttattggaacaagatccggaagattttctacaagcaggctcggatgatgctgaaattgctaaaatagaagaattgatcaagcaacgtaacgatgctcgtcaggcaaaagattgggcgagagctgatgctgcgagaaatgaattgacggcaatgggcgttattttagaagacggttcaaacggaaccatgtggcgaaaaatgtagtgattgaaaggggcgatattctcgcccattttgatacgttacggttagattttacttatcagcagaataatataatttaccaatctcaattttctgacgaccatttgcttcacgccatttgtttgtatctcgtaaagaatagacgcaaccgcagtattcttgttggtaaaaacgttctcgtttactgatttcaatcattcgttgcgaccctccgcctttacgccaattgtaatcccaataaaccacatcatcatatttttccgctgcacgatgtccacaaccattaatttggttcatatctttccaacgagaaattcctaagcaactggtaaaaacagggaaaccattttcatgggcatactgtgcggctttttcaaaacgcatatcaaagcacattgtacaacgaataccccgttccggttcatcttccattccttttgcacgatcaaaccaattttgacgatcataatctgcatcaatgaaaggaattccccatttctcggcgaagcgaatattttcttctttacgaattaaatattcttttaacggatgaatattgggattataaaagtaaattgtaaaatcaatgcctgaagcatgaatagcttccatgacttctccggagcaaggtgcacaacaagaatgtaataacagtttattatgtccatgtggtaattctaatttggggcgtacgaaaggtgtattcgaatttttacattctttcttacgacgcttttgtgcatcaaagtgcggttgcttttgttcaagtttggttctgtgcatatctattttcataaggcttgtttgataacgattaaatttaggggaataaatgtttaatttccccactcaagtctaaaaggtttttcattcaaatctgataagtatttttactacaatactcaatgtctaatcattaatagtgcctctcaacggataaataagccaaagaaattaatgcttgcttatattggttttctggtaaacaggaaattgaatcaacagctttttgagcctcttcttttgctttactcatggcataatccaaagatttttgttctgtcataatggcaagtacatcctccaaaaaatcccgttttccgccctgttcgattgcttcacgaattaatgcagattgttgtggtgtaccattacgcattgcatgtaataaaggaagagtaggtttcccttcagctaagtcatcaccgatatttttacccaaagtcgccgcatttgcactgtaatctaacacatcatcaactagttgaaatgctgttcctaagtatcgtccatagtgttgtaaagcaatttcttgttctgcattactttgagctgttatggcggcacattgtgtagcgacctcaaacaagcgagcggttttactataaatcactttcatataattatcttcacttgtctccggatcattgacattcattaattgttgtacttcaccttctgcaatgatatttgttgcatcggacataatttgtaaaatacgtaatgaattgagtttagtcatcaattggaatgcacgtgtataaataaaatcacctaccaatacacttgccgcattgccgaattccgcattggctgtcggatttccacgacgcatatcggactcatcaacgacatcatcatgtaacaatgtcgccgtatgaataaattcaacaaatgcagcacaagtaataggctcatcaccttgataatttagtgctctggctgccaacaaagcaatcatagggcggatacgttttccaccactttgaacaatgtaataaccgagctgattaatcaaagcaacatccgaattaagttgtgctagaattgtggcattcactttatccatatctgttttaataagagattggattgcatggatattcattgggttcattttttctatcatgctgaaactatcataaattaagctaaaagtgcggttgattgtacctgattttctgagctttctgaaattaaactctataaaataagatttttttattttcttaaaaagaaaggcttgcgaagaagccgtttttttcgtagaattcgcaacctatttatatgaattttgatgtgctaaatgaaaataacattataagcactattatctagcggagtatttatgtacgcagtttttcaaagtggcggtaaacagcaccgtgtaagcgaaggtcatgttgttcgtttagaaaaacttgaattagcaacgggctctactgttgagttcgattcagtattgatgatcgttaacggcgaagatattaagatcggtacaccagtagtgacaggtgctaaggtagtggctgaagttgtgtcgcagggacgtggcgaaaaagttaaaatcgttaaattccgtcgtcgtaaacacagtcgtaaacaacaaggtcatcgtcagtggttcacagaagtgaaaatcactgggattcaagcataatttcacaggagttatagaatatggcaactaaaaaagctggtggttcaactcgtaacggtcgtgattctgaagctaaacgtcttggtgtgaaacgtttcggtggcgaatcagtattagcaggtagtattattgttcgtcagcgtggtactaaattccatgcgggttcaaatgtaggtatgggtaaagatcatactttgttcgctactgctgatggtaaagtaaaatttgaagttaaaggcgagaaaagtcgtaaatacgtttctgttgtagccgaataattttattgatacagagtgatgccccacaatgtttttgtggggttttttgtttttagaaaattaatactttattagcacagttaccagtgcggtgctattattgcacgagttttgtatttatataggagggcgaatatgaaacagaaaccattactcgggtttatatttgcattgactactgcgatagcttggggatctttacctattgcattacaacaagttatgaatgctatgagtatgcaaactatcgtttggttcaggtttatggttgctactgttgcattagctattttacttaaattagcgaacagattacctaaattatcagatctcaatcgttacttttttggactggttatattaggtgttatagggctatccggaaactttagtctgtttaattcctcattaaaatttattgagccttctgttactcaaatttttgtgcatttttcttcctttgcaatgatgttctgtggagttgtgatctttaaagaaaggttaggattacatcaaaaaattggtttagttattctaattattggacttatcttatttttcaatgagcgagcggaccaattatttgatattaatatctattctataggcgtatttttaagtatgtcggcatccttgatttgggtaacttacggactcgcacaaaaattacttttacgccgttttaactctcaacagattttattgatgatttatacagggtgtgcatttgtttttactccttttgttgagattgagcaattgcaaaatctaaatacttttacgctaatttgttttatttattgttgtctgaatacactaataggttatggtgcctatgctgaggcattaaaccattgggatgttgccaaagtaagtgttgtcattaccttggtacctttgttcactattttatttgctcacttattaaatttaatatacccacagtatttttcagcccctgaattaaatacgctcagctatattggtgcgttcattgttgtctttggtgcaatgacctcagctattggttataaatttatcaagaataaaatttaggagaaaaaaatgaaatttattgatgaggcactgattcgtatcgaagctggtgatggcggtaacggctgtgtaagttttcggcgagagaaatttattccgaaaggtggtcctgatggcggtgatggcggtgatggtggcgatgtatatctaattgccgacgagaatttaaatacattgattgattaccgatttgaaaaacgctttgcagcagagcgtggagagaatgggcgtagttctgattgtacaggacgtagaggcaaagacattacattaagggtaccggtcggaacaagagcaatcgataacgataccaaagaagtgttgggtgatttaactaaacatggtaccaaaatgttagttgcaaaaggtggttatcatggactggggaatgcacgtttcaaatcttcagtgaacagagcaccaagacagaaaaccaatggaacaccgggtgaaaagcgagatttgcaattggaattaatgcttttagccgatgttggtatgttgggattgcccaatgcaggaaaatcaacatttattcgagctgtttccgcagctaaaccgaaagttgcagattatccttttactacattagttcctagtttaggcgttactcgtgttgatactagccgtagctttgtgattgcagatattcccggattaattgagggagcttctgaaggtgctgggttgggagtacgatttttaaaacatttggagcgttgtcatgtcttaattcatttggttgatattgcaccaattgatgagagtgatccagcggataatattgcaatcattgaaggtgaattatttcaatatagtgaaaaattagcgaataaacctcgttggttagttttcaataaaattgatacactttcagatgaagaagcaaccgcacgtgcaaagaatattatgcaacgtttgggtggggaagatgattattacttgatttcagccgcaacaggtaaaaatgtagacgttttatgccgcgatattatggattttattgaagaaaatccacgtcaagaacaagaaaagatagatgctcaagaagtgaaatttaaatgggatgactatcatcaagaacaattgtccgaacaggtctttacagaagatgaccaagaagaggatgattggggcgattggtcggaagacgatgaggaaggtgtagaaattatttataaaccttagctacagaataaaatatgagggtttccttttttatttaaattgaatgttgatattcatattctaagtaggaaactctcagtttttgtagtaagctgtctgagcaatgctgatcttctacagatatatcaccataaaatatctacttgtttttagtgatgagcggttatttttcctacatttttttcgtaaaaaagtaaatagagaaaaattgtttttttaatcagtgtttctgcatcagtaactaagatgtctcttcctctaatttattgaaatatctttgccaatcaaaatattgaccagggtctatttttctattcggagatatgtggcaatgtccgacaatacgttgtttggttattaaaggatatgaatgcataatgtctaaagtcagacgttctaaagattgatattgttcttctgtaaacggttgaagattacttccttccaattcaatgccaatagaaaaatcattgcatttttctctcccttcaaatgaggataatccggcgtgccaagccctatcattgaaattgacatattgtgtaatagcaccatcacgagtaatcaaacagtgtgctgacactcgaatgtttgcaatagtggcaaaataagggtgtgcgagaggatcaaggttacctagaaaaaaatcatcaatatacgaaccaccgaattgctctggcggtaagctgatgtaatgaataactaaaagggaaatatcactattttccggacgttgatcaaaatgtggagagggtaattttctagcctctgaaaaccaacctgtgcagatatttttttgtttattgttcataaattattatttttgcgagtcggctcgcagaaaaagtgcggtctatttgtcggtttttttcaatttctacaaactttcacttgccattcggcattgtcattttatttaaaaaaggaaacattatgaaaataacctatattttttcatcagctaaaaaaggatttactctcatagaactgatgatcgttattgctattgtggcaattcttgcaaccattgcaattccgtcataccaaaattatacaaaaaaagctgcgattacagagttgttacaagcttctgctccttatcgtgcagaagttgagctatgcgtgtataacaatgatgcaccgacaaattgtaatgctggaacaaatggaattcaagcggcaatcaatacaccaaaaggtaaagtaaaatcagttagcgtgcaaggtggagccattactgttacagggaatggaaatcttaaagatattacttataccttaacaccaacaggcgatgcttcaaccggcgttacttggagtgcaaattgcaataataaggctgatctatttcctgccggattttgctcttctacgtctacaaactctccttaaaccattaattacggtgggttgtctcaccgtttcatattaattgcactataaaaagaatttttttgcaaaaatattgcatatttattcaaacggtgataatgtttgcgtaaatcaattaataaccaaaacgagatcttttattcaaatgacaattagtgttaaaaatttaaattttttttatggtgcatcacaggcactgtttgatattaatctcacagctgaagatggtgataccgttgttttattgggaccaagtggtgcagggaaaagcaccttgattagaacgttaaacctacttgaagttccaacatctggagaattgagtattgccaataataaattcgatctctcgcaagatattgccaacccaaagcaaatgcgtcaattgcgtcaagatgtaggtatggtatttcaacaatacaatttatggcctcatttgactgtaatggaaaatcttattgaggcaccgattaaagttttagggatagcgaaagaaaaagccaaagaacaagctattgaattattaaaacgattacgcttggaagaattcgctgaaagatttccactgcacttatcaggaggacagcaacagcgtgttgctattgctcgtgcattaatgatgaagccgcaagttttattatttgatgaaccgacagcggcattagatcctgaaattacagctcagattgtatcaatcattcaagagttacaggaaatgggcattacacaagttatcgtaacgcatgaagttgcggtggcaaaaaaggttgcaaccaaagttgtctatatggaacaaggtcgcatcgttgaaatgggggattccagctgttttgaacaaccctcaacagagcaatttaaacaatatttatctcactcacactaatatttaaggagcttattatgaaaaaattacttttagcaacaatgttggcagctgctacgattggtgcaaatgcacaagatattacttttgctatggaaccaagttatccaccatttgaattaactaatgaaaaaggtgaaattattggttttgacgttgatattgctaatgcaatttgtaaagaaattcaagctaattgtagcttcaaagcccaagtgtttgatgcgttaattccaagtttaattaaaggtcgcggtgggtttgatgcggcaatttcagcgattgatattacggaagcccgtgcaaaacaagtagcatttaccgattcttattatgaaagttcagccagttttattgcattaaaagggaaagcggatttaacgacggcaaaagtggttggtgtacaaaacggtacaacgtatcagcaatatgcgaataaagaagcgaagcaatatcaatctaaatcttatgccagcttacaagatgcaattttggatttaaaaaatggtcgtattgatctcatttttggtgatacggatgtattaagagatatgtttgataaaaatccggaattgcagtttgtgggcgagcgtgtaacggataaacgttatttcaataacggcttgggaattgcggtaaataaaaagaataccgcacttgttgagcgattaaataaaggtatttcggcaatcaaagcaaacggcgaatatcaaaaaatttatgataaatggatgactaaataattttatgtttattgattatttacctttaatgtataccgcaaccctgatgaccttagggttggcggtttgttctttattactcggattggcattatctattttctttgtagtattagaaacacacaaatgggcatgtattcgtaaaccgacagccactattgtgacattattacgagggttacctgaaattcttgtggttttcctaatttattttggcgtacctgaaatactggaatgggtaatcggagaatatgtagagtttggtgcctttggttgtggcgtggttgcactgtctattatttttgcttcttatgcttctcaatctttgcgtggagcaattcaggctatacctttaggacagtgggaatccggtgcggcattaggtttgagtcgtagttatacgtttatttttcttattatgccgcaagtttggcgacacgctttaccgggattgagtaatcaatggttagtgttattaaaagataccgcacttgtgtcgttaatcggtgtgcatgacctaatgcgtcaagctgaattaatcaataccaatactcaccaaccttttacttggtatggatttgcagcattgctttatttgttgattacgctatttagtcaatttattattcgtaaacttgagcggcgagtcacacgctttgaacgtgctacaaattaaaggatgaaaaatgattaaagattattttttaacaattgcacaaggaattccaacaagcttaattcttactatagttgccttgctggtagcattttttcttgctttgacattaacttttgctctttctatggaaaaaaaatggttaagtcttccaattaatctttttctcacaatttttaccggtacaccattactggtgcaatttttcttaatctatgcaggaccgggacaattttcttggattgtaaatagttttttatggcctttattatcaagtgcgtggttttgtgcaatacttacattagctttaaatagtacagcgtattcaactcagcttttttatggtgcggtaaaagcgatttctaaaggacaatgggaaagctgtgttgcactaggtttgagccgttggcaaactttgaaaattcttgttccttacgcattaaaaagagcattaccttcatatagcaatgaaataattcttgtctttaaaggcacatcgcttgcttcaattatcactattttggatattatggggtatgcaagacaactttatggtactgaatatgatgcactgacaatttatggtatcgcaggcgtaatctatctcattattacaggtattgctactttattattacgcagattggagcgtaaggtgcttgtatttgagcgtttagaaacggagcgagtgtaaatacacaataacaaataccgaaaagtgatctgtgccttaatttatcgtttatgagttatctatttaagatttaaggaacagatcaatatcggtaatcaccaattgctatttcgtatgaagttttgccaatccgatatcacaacttttgatttgtatatcatgctccatggcgagaatttgttgcttactttgttttaatttactttttatttttgccagttgaacatgtgttcccggctgtttttctgcctcagcaattagattttctgtttctttaaataatttttggcactgctcaggcagagtgtttgcttggacatgagttgttgttatagttgcaaatacgctagctaaaataatcattactgatcttggttttagcattatattcattgataacctcttgaaattttttcagaaaaccttcggaaactatcaaaaaaagactgacatgtctagttatttattgcttcatatttttttgtaaatttttactatttggaataaatgttaaaaattgtgaatattctataatgtttgatgtatatcaatatataagaaagtgttaaagaaatgttatttgatttagatctaaaaatgtgatctttataacacttttattgttttttattcttacttttagtagtaaaattaataccgtttttgggttatccacatgacatttaatggtgaactgtgaaacttatgtaaattttatgttgtatgttcatttaaataaatgtttatgaggatagttcagtaaatctacttgaggtttcaacttgagtatttgaggggtggttacatagtaatcattgtgaaaaacttgtagcattgcacaaggagttggagatgttggacgttgttgaactctctagattgcagttcgcgttaactgcgttgtatcactttttgtttgtaccgctaacattgggtttgtcatttatccttgtgattatggaaactttatatgttgcaacaggcaaagaagtgtataaagatatgaccaaattctggggtaaattgtttggtattaattttgccttaggcgtgacaactgggattacaatggaattccaatttggtactaactggtcatactattctcattatgttggtgatatttttggggcaccgctcgctattgaagcattacttgcatttttcttagaatcaacatttgttggtttgtttttctttggatgggatcgtttatcaaaagctaaacatttattaactacatattgtgtagcatttggttctaacttttcggccatgtggattttagttgccaatggctggatgcaaaatccggtagcgtctgagtttaattttgaaacaatgcgtatggaaatgaccagttttatggatctttggttaaaccctgttgcacaaagtaaattcttgcatacattgtctgcgggttatgtgactagtgcatgttttgttttagctattagttcatattacctcctaaaaagacgtgatgtcggattcgcaaaacgctctttctctattgcatcagttttcggtatcattgcaactgtttcagtattgatcatgggtgatgaatctggttacgaaattggtcaaacccaacctgtaaaattagctgctatggaaggtgaatggcatactcaaccggctcctgcgtcttggaatatgattgttgtacctaatcaggcagagcaaaaaaatgattttgctttacaaattccttatgctgcggggattattgttactcgctcattagacaaacaatttacaggactagttgatctacaagctcttaatgagcaacgagttcgtaacggtatggttgcctatggtttactacaacaattgaaggctgagaaaaaggccaacggtcaggttaatgaagaaactaaagcacaatttaacgcagttaaagatgacttaggatttggtctattactcaagcgttatactgatgcggtcgtagatgcaactgatgagcaagttaagcaagcagctgctgatactatcccaaatgtaggaccaacgttctggtcattccgtataatgatgcttgccggtggtttaattctagttctgatgattgctgcattcgtacaaaatatgcgtaaaacagtagggcgtagtccacttttattaaaagctttattatgggggcttccacttccatggattgctatggaaagtggttggttcttagctgaatatggacgtcaaccttgggctatttatgatgtactaccggttggtgtggctgcgtcgaatttaacaacagctgatctttggttatctattggactgatttgtgccctctatacaatcttcctagtagtagaaatgtatttgatgtttaaatatggtcgcttgggtccgagttcgttaaaaaccggtcgttattattttgaacaattatctaaataagcaggagtctaaccatgattgattatgaatttctacgttttatttggtggattttagtcggggtactgcttattggatttgcagtaacagacggatttgatatgggagttcttagcttattacctttcgcaggcaaaaaagaagttgagaaacgtataatgatcaattctatcgcaccacattgggatggaaaccaagtttggttattgactgcaggcggtgcaatgtttgctgcttggccgatagtttatgcagcctctttctccggcttttatgttgcgatgattttagttttagccgcactatttttccgtcctgtcgggctagagtatcgtgctaaaattgataatccaacttggcgtaaattttgggattggggattatttgctggtggttttgtcccatcattggtattcggtgttgcattcggtaatttattgcaaggtgttccatttgaatttaatgatttgatgcaagtaacttatacaggttctttctttgaattattaaatccttttgcgattctttgtggtttaatcagtttttctatgttaaccacacaaggtgctgcttggttacaaatgaaaacaacatcagaactgcgtgagcgtgctcgtgtaataacacaagtaggtgcttttgttacattgttgacgtttattttggctggtgtttggttatatttcaaagaaggctttattgtaacaagtgtccttgatcataatgcaccatctgacccaactgttaaaacagttgcagttgaagtgggagcttggtttaagaattattttgatgcacctgtgttgtttattcttccagcattagcagtgggtggtgcgttgttaaatattttggcatcaaaagccaaccgttcaggatttgcatttttcttctcgtctatcacgatggcaggaattatattaacctgcggtgttgccatgttcccatttgtgatgccttctatttctcatccgaatatgagtttattaatgtgggattcaacatcaagtgaattaacattaacactaatgcttggttttgcactgttctttgttgttattttactgagctacaccatttgggcttatgcgaagatgtttggtcgcttagatgctgacttcattgaagaaaacaaaaactcattatactagtaaggagataagattatgttttatgtgttatgggtagtgggtgttttgttcgctgttatgctaagtgcaatcattactatcagtcttgagaaaacgggtaaacttgacgaataaggatttttctttattgactgaaaaataagggcttctaaagagcccttttattttttcttttgtgtaaatttttcatgatcaaaagtaaaagtatttttaactaagcacagggtttattttaaggtgcgatgtatagtctaaaaaaatatttttcttttcattgtatttattcttgctaatatatttgactgaatctagaatacttggttcatttttcatatagaaatgagaaaataaaagactttgtgagggagagtaatatgcctgtttttaaattgcctgttcgtgtgtattacgaagataccgatgccggaggtgttgtttatcatgcccgttatctccatttttttgaacgggcgagaacagaatacttgcgaacgttgaatttttctcagcaaaatctattaaatgagcgaaaagttgcttttgttgtgaagtcaatacggattgactactgcgttcctgcaaaattagatgacctattaattgtggaaacttatgttgtagctatcaagggagcaagtatagttttttcacaaatattgaaacgagatgatgagatcatttcacaagctgtggtgaaagttgcgtcagtggatcttgtgaaaatgagacctgtggctatacctcaagaaataaaagcagaaattaaactaaatgataacattttcggagttatgtcatgaccgctgaattagattttttagaattatttttaaaggctagtattgttgtacaaattgtcattgtcatattaatatctttttcgattatatcgtgggcgattattatccaacgtagtcgcattttaactcgagcattaaaggacagtacactttttgaagaacgtttttggtctggagaagatttgtataaattatatgatggactttctaatcgtcgtaatggtctaaacagcagtgagcgaattttttatgttggatttaaggagtttaatcgtctgaaacaagctaatccggatgcccctgaagccattattcaaggcagttctagagcaatgaatttagcaatgaatcgtgaagtggaagatttggaaacacgagttccgtttttggcaactgttgcgtctattagtccatatatcggcttatttggtacagtatggggaattatgcatgcttttatggcattaagtggtgccaaacaagcaacattacagatggttgccccggggattgctgaggctttaattgcaacggctattggtttatttgctgctattccagctgtaatggcttacaatcgtttaagtctacgtgtgaataaattagagcaaaattatgctaacttcattgatgaatttacgacaattttacatcgtcaagcatttggtaaaaatcattaaatgtatcaaaattctccgtactgacggataaagtgcggttcttttttcataagtttagaggctatctatgtcttatcgtcgaaaacgtcgagatattaagtcagaaattaatattattccttttttggatgtcttattggttttattgctcatttttatggcaacagcaccgattattagtcagagtgttcaagttgaacttcccgaagctgtagaaagccaaaatgtatctaaagaagataaaacgcctgttattttggaggtttcaggtattggacagtatgcactttccattggtggagagcgaactgaggggataacagaagaattagtaactcaactttctaagcaagaatttgacaaagataataatacgttatttttggttggaggggctaaagatgttccgtatgaggaggtaatcaaagctttgaatttacttcatgttgcgggaataaaatctgttggattgatgactaatcctctttaaatataagtaggtaacacagtgtgtaatcatcgacaaaaaaatgagcttggtgccattctgctatcaatttttctgcatattttgttattaagtttgctggtattaggatctaactataataatgttgaaatcatgggaggtggagaaggtgatggtgaagtaatgtctgctgttatggttgatacgggaactattgcaaaagagtggggacgtttacaggaaaagaaaaaaagcaatccggataaacaagaaacctttgttgaagcaacgcaagaagacgagttaatggagaatgttgatgtatttgaagaaaaaataagagaagatgaagatgtacagaaaagacttgcagagcaaaaaataaaagaagaaaaaattcagcaagagcgtttagcaaagcaattggaagaagataatgccaagaaagagactgttgcaaagttgaaagcagaggctgaagaaatgcgtttacaggcattggcaaaaaaaattgaagaagagaaaaaggttagagacgctgaggaaaaacaaaaagcagagaagttagcgaaagagagagcagagaagttagcaaaagagaaagcggatagattagccaaacaaaaggcacttaaggaagcaaaaataaaagcggaaaaagcagctaaagcaaaagcggaattagctcaacgcaaagcggaacaagcggcgttagatgattttttcaatggaggtgatattgcaggaagtagcaaaaatggtggaaatatgacgatgaaaggttctcaaggagtggggactggttttgaaaacggcaaaggcggaagaactggagagcaatatgccgctcaaattaagagagaaattcagcgtcgctttctaaaagaacctaggtttgctaataaagtttgtgttattgaggttgaattagcaagagatggaacgatcactaactttagaaaattatctggctcagatgatatttgtactgcggggttatcagcggtatctagaacgaaaaaggtaccggaggcaccaactgatgagatttatagaaaatataagaaattcccactcgaatttagattgaaataattaaagaaactaaaaggtaaaatttatatgaaattttctgcatatttaactacattattcatagtactttttagtttgttcatacaaaccgtacaagctgaaagtgaggtaagaattgtcattgatgaaggggttgatagtgctcggcctattgcgataattccatttaaatggaatggtagtgactctatgccgatagatgtagctgatatcatttctgcagatttacgcaatagtggtaaatttaatcctattgcagtcagtaaaatgcctcaaaaaccgacatcagcaagtgaggtaatttccgatgtttggtcttctttaggcattgatgcagtagttgttggacaagttacaccaaatgaaaaaggatatagtatcgcatatcaattagtagacactatcggtgcttcaggaaatgcgggagaggtactaagtcaaaaccagtacgctgtaccgaaaaatgctattcgtttaggtgctcataccatcagtgatgaagtttttgaaaagctgactgcaattcgtggtgcatttagaactaaaattgcatacgttgtacaaaagaacggtggctcaaaaccttatcaagttcgtgttgcagattatgatggacataatcaatttattgtttatagtagttcgcaaccattgatgtctcccgcttggtcgcctgatggtagtaaattggcttatgtatcttttgaaaatcgtaaatctcaattaattgtacatgatttacagtctggagctcgtcgggttattgctgcattccctgggcataatggagctccggcattttctcctgatggttcaaaattggcatttgcttcatcaaaagatggcgtattaaatatttatgtcatgaatttaggaagcgggactatctctcagttaactagcggtgcaggcaacaacacggaaccttcttggtcaccggatgggcaatctataatttttacttcggacagagacggcggacctcaaatttatcagatggatgtatttggtaatggtatatcattagtttctgctggtcgggggtatagtggaaaaatctctgcagatggtagtatattagtgatgatttatgccgataatattgttaaaaaagatttggcgacaggtgtgacggaaatgttaagctctactttcttagatgaaagcccaagtatttcacccaatggaattatgattatttatagttctacacaaggtctaggaaaggtgctacaattggtttccgctgacggtcgttttaaagcacgtctaccaagtagtgacggtcagattaaatttccagcttggtcaccatatttaaataaaaactaggagaggttaatgaaaaactttgcaaaattattagtagtagcgggttcagtggcagtattggcagcttgtagctcatctgataactcatctaaaacaaatgctcaaatgtttggcggttattctgtaactgacttacaacaacgttataatacagtgtattttgaatttgatagttatgatgtgcagggcgaatacgctcaaatcttagatgcacactcagcatacttaaagtcaacaccagcttctaaagttcttgttgaaggtcatgctgatgaacgtggtactccggagtataacatggcattaggtttacgtcgtgctgatgcagtaaaaaactttttattaaataagggtgttcaagctagtcaactttcaaccctttcttatggtgaagagaaaccggcagagttaggtcataatgaagctgcatattctaagaaccgtcgtgctgtattagcatactaatttcttaagccgggtatgatgcccggttttttattgcattttttcggtaaattttgaatttaagtgggtatatttgttttaaatgccccttttctgccgactattcgttcaaataaacaaaaaataaaaaaattttattgattattaaaataaaaacagtaatatatccgctcgttacaaacaatgagggtcgttagctcagtcggtagagcagcggacttttaatccgttggtcgaaggttcgaatccttcacgacccaccattttatttgtaatatcccaatttatgggtcgttagctcagtcggtagagcagcggacttttaatccgttggtcgaaggttcgaatccttcacgacccaccattttatttgtaatatcccaatttatgggtcgttagctcagtcggtagagcagcggacttttaatccgttggtcgaaggttcgaatccttcacgacccaccagtcatgtttaaagattcattcataaaaatattggttattcttatttatcgtgtcttttctgtttgtttctcttaagaggacatatacttaaaattagtcacttttctttttactaaattctatttttgcgatctgtatcgtaattttttttaattatttttacccatttttccagatgagttaaagtgcggtcaaaaataggaaaaaaaatgaaagcattaaagggggttactctattagaaatattgattgttttactgattatcagtatgacagtaacattttcttttcccatgtggcaaacagcaaatacaaaaatgattttagaaaaagagcaaaataaactctatattttcataagggagttacaagctcgagttgaaaattctaatgatatttggtttttaattgctaatcgtgatttagtgagtaagcgttggtgtctggttgcacaaccaaaaaacacagatatatgtgattgtttaaatcctcgcagctgtaatagaaatattccgatgaaattttattatccttattttgcagataaaaccatgttaatcagcaaagtttattatcctagagaaatgactagattaaacggtacaaggaatacaagtacgacgacttgttttgtattgcaatctgatcagcaaagaacagtattttcgttttttaatgtaggatctttaaaacttaaaggttaccaatcgttaagtgcttgcgtgaatgatcattagtaagggggaacattgattatttatcgtggacaaactttattaagtgtaatgatagcgttgagcttatcaatgatgttattaatgagtgttagtgcattttatagttatagtcagcaacaaaataaacagatacttttgcatctctatttacaatcagaattgcaacgaactatccaacttttgggtaaggatattcgccgtagtggatttagggctattagtgataaattggttcggagtaatttcgatttatttgaacaagataaaagcggaaagagtattgtagtcgctcaagctgataatgaaccttcgaatagttgcgttctttttatttatgatcttgatgctaccggctgtgtaggtacgacatatcgtaataatgtttgtgtaaggaataaacaaaatacagctcgtgaaattgagcgagagttatttggttatcgcttaaataaacaaatgatagagacaagattaacttataaaaattcaattagcgcgaattgtaatcaaaaacaatgccaaagctatttacaacaacctgcatgtaatagcggagggtgggtcgatttattagatgaaaatgacatagccataactgcattaaaatttcattggattgctgattacaatggattggaagtttatctaaaagggcatctaaagcgaaataaacaagtcgaatatgagacttcagccattattcctttgcttaatcaaaagagataaaaatgaatatacaaaaaggagttgtaacgctcaccctattaatgctgttaagctcagtattattaattttacttttttttgatggtgatttgatttcgttgcattcatccattgtttctcaacggaaaatatatttagaacaaagtcttatattacagagacaaagtatttctcaaaaagaaaaactttgtgaaaaccagcctctgaataataatttgaaaagtttgaagatcgaatttgaaagtcgacgaaaaattgaccgcacttctcaatttgtatggtgtgaaagaaaatatttgtttaaaaaaaggccgaaaaaagctacttatgaggcagggctaagtcagtatataaatcttgagttactggacttatttcaacataaattacattcaccgcctgctattttgccgagagataaagtaaattacctctattgggttgaggaaaaatcagctgaattggagatacaaggtaatattaatgcagttgttattgctgaaggggatttgaagttaataggaaaaggtaaaattagtggaacggttattaccggcgggaaattaagtattgaaccagcagttaaaattgtgtatcgctcaaaaacaatcatcgatcttatccgatcatatagttattggcagtttgcggagaatagttggtatgattttcaaccattataaatttcctcaacggggtaccagcttgatcacgttattagtcacaatgatgatattttctacattatttttatttgttaatcaatgggttagttatcaaagaaaaagtgcggtaaatatttatctacgttatcaagctttgcaaatcgctgaaaatcaacatcaacgcttatttctagaaccgcattttcattgtccgcataatatcgagcaaaatggttataagtttaagatcaattgtgaaggtaagaatgtacgagtttcttatgcaaatcaacaagtaaatttattgcttgattaattattttgaaaagctatgctaaatgaagttattagaagaataaggaacatttgtgtttactttgtattattccaatcaattggaaacgcaaaaagatattttgttacatttaatggatcaacagccattatcagatcctttccaaaaagaagttattttagtacaaagtggcggtatggcacagtggatacagtggcagattgcagagaaaaaaggtatatcggcaaatttgtcttttcctatgcctgcaagttttatttggcaattatatgttgataatttaccgcaagtcacagcttcttctcaatttagtaaagaaaatatgacttggcgattaatggaaattattccgcattatatagatcaaccggaattttacatattgcgtcaatatttacagcaaagttatcaatcaagtcagcagcgatactaccaattagccagcaaaatagcagagttatttgaccaatatttagtttatcgaccggaatggattataagttgggagcagaataaaggcgtagaaattattcagcaaattcagtattaccaaaaaaatttatttgtctcagaatcatgtttttctcaagttgagcaacatattgtttggcaaggtattttatggagagctttagtatgctctgtgcaaaaagaaacacaaaagaatgttttacatcgtgcacatctacatttacttttcttaaaacatattgccggcgaaaaacctaaaaatttgcctacgagaatttttgtatttggtatttcagctttaccgaaggtgcatttagatactttaagtgcattaagccagcattgcgatgtgcatttattttttaataatgcttgtcgtgaatattggggagatataattgatcagagccattggcaacgtttgaaagtgcgagagcgtataagttggcaagatttccaacaaccacaaaatacacaggcttggttatccgatgcgcaaatacatacttttgaacaaaatggatttgaacaaatttatgatgaaaagttacaggttggcaatcctttgctttcctcatggggaaaattaggacgggattatttgtatttactcactgaactggaggctaatgaaatcaatgcttatgtcgaactttcggaaaaaatattgttgtcgcaagtacaggcacgcattttagatttggttccttcgaagcacaagtttttaaatttggcagaaaatgaccgctctttaacttttcattcttgttatagtccaatacgagaggttcaagctctacaagattatttgttacatctatttaaccaagctcaggatttgacacctaaagatgtggtagttatggttgcagacattgataaatatgcaccgtatattcaggcggtattcagtcaaggcgaacactatattccgtactctatcgcagacagcaaactttccgaaaatgaccctttagtatctgcttttttacagctgttaaatttaaaagaaagtttattcagtgcggaggaagtgctgacttttttggatcatcctgttattcgtcagagttttaatattactttagaggatttggcacaaattcgtcattgggttgagcattcgggtattcgattcggattagaaaaatatccgcaacaatccttgcaaaattataacgcttggcaggcaggtttagagagaatgttactgggatttgctatgcgggaagaaaatggtctatggttagatacgcttggctttgatgatacctatggattaaaagggcagcttgtcggttatttaaaggattttattactcgtttgtatcaatggcatcaatttttgcaagtagatcacgttattgaaaagtgggaagaacatttaattgaattaatgtcatctttttttgtggtagacggaatggatattccgcaacaatacaaaacaacttttaattatcttattgacactattcaacaattaacggagttgatcctagatagctcttttcagcaagaaataagtgcggaggttatttacgaagtttttgttgaacgcttaaaagatatacctaatagcctaaaatttttaatggggaaagtcactttttgtacgcttctccccatgcgatcaatcccttttaaagtggtgtgtttacttggtatgaatgatggtgattatccacgtcaacaaacgccgaacagctttgatttaatgcaatatcatcgcaaaaaaggcgatcgttttcgccgagatgatgatcgctatttatttttagaagcattgatctcggcacaacagtatttttatgtgagttatattggtcgctctattattgatgatagtgaacgagaaccttcagttcttgttacgcaattgttggattatatagctgaaaatattaacgctcaaggtgatctaagaggacaagatattctgaaaaaatcacttattcaacaacatgcgatgactgcatttagccgagaaaatttcaccaaaagagaccgctctttttctaagcaatggctagtgttggcaaataaaaaagatagtggcaatttggcgaattttttacagccgataaatgatacagagatagttaaagaaatttcattaaatgacttaattgcgtttattcaggatcctgttcggtatttttttgagcaaaaattacgtgtttttttacgtaagacagaacaaaatattgcggatactgaaaattttactttagataatttagagttatatcaaataaaagaagaacttatttatctttctgagcaggaatgggaagacttttttgctcggatgaaaattaagggaattatgccacaaggggcgtttgcaaaaatttatcagcaaaaaacaaaaaatgagatcattacacttaaatctttagttacgccttatttggataaaatatcggaacaaatccctcttgatttacacattgaaacagaatacggaaaggtacgtttaatcggtagcattgactgcttatatcatcaaaaaatgcatcgagtaacttggcgagcatctactatcaaaacgaaagatattatccaaacatggatttatcatttagtacaaactttagcgggagagcctaattcgcaaattgagcattactctttagacagcagactttcttttgaaaaaatagaaaaatctaccgcacttcaacagcttcaaacttatgttgaggcatatttacttggacaagtttcagtgttattaatgccaatgaaaaatttcgatcaatatcttcaattgctttttactccgaagagtaataaatggaaagaggaaaaagatattgatttatctgcttgttttgaattgttatcagaacttggctcaggtagaaaagagagaaatttttatgtgaaaacagatccttattggcaaagaatattagcacaaacaaaactagacgattcacatattttagaaattaatcaacgtgttatacaatggttcgatttaatgttaatgctaaaaagagttgaatagaaaataaaaacaaaactggatatttatccagttttgttttatccttagtgctttattttacgctatgtaaggtgagatatgattgggcgtgtaacaggaatactggttgaaaaacaagctccggaaattttactggatgttcaaggtgttgggtatgagttacttttacccatgacaagtttttataatttgccggaagttgggcaggaaactacgttgtttacgcattttgtagtgcgtgaagatgctcatttgttatttggatttagccataaacaagaccgctctttatttcgtgaattgattaaaaccaatggagttggaccaaaattagctttagctatcctgtctgcgatgtcagtgaatgaatttgtgtatgcgattgaacaagaagaattatctaaattagtcaaaattcccggagtaggaaaaaaaactgctgaacgtttattggtggagctaaaaggtaaatttaaaggcttacaacaaacagatttctttattaaaagctctcatttacctggaattaaatgctcaaaaccggatcaaagtttgcagttggatgaagcagtttctgctttaattgcgttaggatataagcctattgaagcagagaaaatggttaaaaaagtgttaaaagcagatttaactagtgaacagcttattcgagaggctttgaaagccgcattataagagatagagaatgattgaagtagatcgcattgtaagtgccaatgcaaaagtagacgatgaatatattgatcgtgcaattcgccctaaattattgagtgattatatcggtcaacctcaagttagagagcaaatggaaattttcatccaagcagcaaaattacgccaagatgcacttgatcatttgttaatttttggaccccctggactaggaaaaacaacgttggcgaatattgttgccaatgaaatgggagtgaatattcgtactacttcaggtccggttttagaaaaagcgggggatttagcggcaatgctaacgaaccttgaacctcatgatgtattattcattgatgaaattcatcgcttatcaccagctattgaggaagttctttatccggcgatggaagattatcaactggatattatgattggagaaggtcctgctgcccgttcaataaagctggatttaccgccttttacgctgattggagcaacaacaagagcaggctctttgacttctccattacgagatcgattcggtattgtgcagcgactggagttttattctgtagaggatttagcttccattgttactcgaagtgcggtctgtttgcagcttgaaattgatgttgacgcaggacaagaaattgcttgtcgttcacgaggtaccccacgtattgcaaatcgcctattacgccgagtgcgagattatgccgatgtcaaaaatggtgggaaaattaccgcacttattgctcaagaagcactgaagatgctggatgtggatcttgcaggatttgattttatggatcgtaaattattacaggcaattattgagcggtttgatggcggacctgtaggattggataatttggcggcggcaattggcgaagagcgagatactattgaagatgtattggagccttatttaattcagcaaggatttttacaacggacacctcgtggaagaatagcaacatcaagaacttatcgacattttggtttggaacagattgaaaaatagcactcctttttcagtcactctcaacgtgagtcagtcgatagtcaaggatttcaagcaacttgagggtttgtgcgagtatccttccattctgtagtaaagattctgcaaaggtactatttattgctcaaaatcccatttgcacacacataggctgagctccatgcccattggaagttataaccgccaagccgaccggtaacatcaagtacttcaccaataaaataaagacctttgattttatgactttccatcgtttttgatgagatttcttgcgtatctacgcctccaatagtgacttctgcggtgcgataaccttcggtgccgttaggttgaatttgccaatgatgaattaaatcatcaagattttttaactgcactttgctgaggttggcaatcacttcatcttgaataatgttgtgatttaaccataaatccactagtttttgcggtaataggcgtgataaggcggtttttaaatgtaatttaggtgaggtctgacgtaacttgttaaggaaaaattgaatattttccatcggtaacagatcaatttctatattttcattcacttgccaataatttgaaatttgtaaaatagcgggacccgatatcccccgatgagtgaagagtaaattattgctgaaagattgaccgcactttgcggttacacaaacaggaagggagatgcctgaaagtgcggtgtaaaatttatcaatttcacgccatgtgaagggtacaagcccagctcgtggagcaataacattgagcccgaattgttcggcaacttggtaaccgaaaggtgtcgaactcaaggctggcatagacaatccgccggtagcaataactaaattttcacattgccaaatttttccgtcagattgcaattgaaaacgagctttttcattaccgtctaatttttcaatgtattcgatctgttgacgtaattgggtattaacttgaaatttatcgcattctgctcgtagcatattgacaatatcttcagcactgttatgacaaaaaagttgccccgattctttttcataatagctaataccatagtcagtaatgagggcaataaaatcccattgggtaaagcgagctagagcagacttgacgaaatgaggattttgcgaaaggtaatgctgaggggtaacattaaggttggtaaaattacaaaatccgccaccggacattaaaattttacgtcccactttttttccattatctaaaatcgttacttggtgcttggctttacctagttgaccagcacaaaacaagcctgccgcacctgcaccgataataattgtttgggaataattcatcattatttattcgctaaaattaccgctcttttgggagccgggtacccttcaatggttttactgtgatcttgaggattaaggaaatcaattaaactttcattttccagccagtctgttttacgttgttcttctagacctgttgtttctacatcgacacaacgaatattatggaaaccgcacttttccagccagtttatgagtgcgagaacggaagggataaaatacacatttttcattttggcatagcgatctgtcggcactaaaatcgtgtttatatcaccctctacaactaacgtttcaagtactaattcgccatctttaactaattgatttttaagttgtgtgagatgatccaatggagattttcgatgatataaaacgcccatagaaaagacggtatcaaaggcggctaaaggttgcatttcttcaatgccgagcggaatcagattagcacgacgatcattgtttaacagtttacgtacagcctcaaattgacataaaaacagttctgtcggatcaataccgactaccattttggctccttcgccaaccatacgccacatatgataaccgctaccacaccctacatctaacacaagacgattctgcaaaggtgccaaatgaggcaagacacgctcccatttaaaatccgaacgccattcacaatcaatatggataccatatagatgataaggtcccttacgccaaggcataagctgttttaagtgatgaatgatgcgttgtcgctcaccggaggaaagaggcgtttttgtttcagctttgaccgcacttttgagatcaatatgatcggctgttaagtgcggtagaaaatcaatgatttttgaccatttaatataatcgccatgggtttgcttttcccattgtttaagttgtaaaggcaaagtttcaagccatgctgaaagtgtcgaagttgctatttgttgataaaatggacgaaagtcgaacataattattttgatgtcttatatgcgtttttagcttgttcaaacgtctctaaaatcgatttttccggtttcactgataacaaagaaacaacaataatgacaatacttgccaaagcaaaacctgggatcatttcatataatttagagaattcacttgttgtagggacaatggttttccaactaaatacgataattgtcccagttaacattcccgccattgcagcagaagatgtcatgcgtttccagaataaagaaaatagtacaacaggcccaaaagcactaccaaatccagcccaagcaaattcaactaattttaaaacttggcttttttcatcttgtgcaatccaaattgcaatggcggcaatagctaataccattaaacgaccaagccacatcaattctttatccgatgcttttggacgaataaatcctttgtaaaaatcttctgtaacggcactggaagaaatgagaagttgtgcactcagcgtactcattactgcggctaaaatagcagaaagtaagataccggcgatccaaggattgaacaataattttgataattcaataaagatttgctccgattctttgttgacgacaccagctagttgtggatttgctgcaaaataggcgatgccaaaaaaaccgatacctatggcaccgactaaacaaaggatcatccaagtgatactaatacgtcgtgcgttattgagcgattttactgtgtgtgccgccataaagcgtgccagaatgtgcggttgtccgaaataacccaatccccaagaagccaagctcagcagaccaattgtggtagtaccggtaaaaatatctgtaaagttttttcctaccgcactttcagcctgcttcaagtagaaatgaaaattatctattccgtctaagcttagaataatcatgataggggttagaatgagtgcgaaaatcatcaatgttgcttgaatagtatctgtccaactcactgctaagaaacctcctatgaaggtataagcaatagttgccaatgcaccataccaaagtgcggtggaataagggatactgaacagattttggaataattttgcaccggcaacgacaccggaagcacaataaattgtgaagaaaacaaggataattgaggctgacacaattttgagtaaattatgacgactaccaaaacggttgtgaaaatattcaggtaatgtgagagcgttattattaaattcagtgtaaatacgtaagcgacctgccacaaataaccagttaaaataagcaccgattgttaaacctatggcaatccaaccttcaattaagcccgacaaatagattgtacccggtaaacccatcagcaaccaggcggacatatctgatgcaccggcagacattgcggtaacaaaactgcctaaacgacgaccgccaagaatgtagtctgaaagattattggtgtagtaatatgcaagtgcaccaatcaataacatgcctaagatatagacaataaaggtaataattgttggatcaaaactaaacattaagccctcacgaaagcattatttgtatagataaaatttaagaaaggtcgcattttaccttattcagggctattattctatttaccttttcgatagactaattaaaagaagtatttttaggatagagatgatggaatctgttgaattattggctaacattacccctagtgaaacccgaattgcactggtggataatggcattttaaaagaagtacatattgaaagacaggcaaaaagagggagcgtcggtaatatttataaaggacgagtgactcgagtattgccgggtatgcaatctgcatttgtagatatcggattggaaaaagccgcttttttacatgcctcagatattgtttcacatacagagtgtgttgatgttgatgagcaaaaacagtttgtagtgaaagatattgcacaattggtacatgaaggacaggatattgttgttcaggttgtcaaagatcccctcggtactaaaggtgcaagattaacaactgacataacactcccttctcgttatcttgtttttatgccggaaaatagccatgttggcgtttctcaacgcattgaaagcgaagaagagcgggcacgtttaaaggaacttgttttaccgttgtgcgatgaattgggcggttttattattcgtactgctgccgaaggagcaacggaaactgaactcgtgcaagatgcggaatttttaaaacgattatggcgtaaggtgttggaacgccgtgcgaaatatacaacacgttcaatgttatatggcgaattggcgttaacgcaacgtattttgcgagattttatcggggcgaatttcagtaaaattcatattgattccaaattatgtttttctgaagtgaaacagtttactgaggaatttatgcctgaactgacagataagttggtgttatattccggcagtcagccattatttgatgtttatagcgttgaaaatgctattcaaacagctttaaatagtcgtgtaaacttaaaatccggtggctatctaattattgaacaaaccgaatctatgacaacgatagacattaatactggtgcttttgtgggtcatcgcaatttagaagaaactatttttaatacaaatattgaggcaacaaaagctattgcacaacagttacaactacgcaatctgggcggtattattattattgattttattgatatgcaaacggaagaacatagggatcgtgtcttggaatctttacgtttggcattatccaaagatagagtgaaaacgaatgttaatgggtttactcaacttggtttagttgaaatgacacgtaagcgaacaagggaaagtttggagcatattttatgcgatgaatgtccaacttgcagtggacgaggcagtgtgaaaaccgttgaaacggtttgttatgaaatcatgcgtgaaattattcgtgttaatcatttatttgccagcgaaaaatttgtagtttatgcctcaagagcggtggcggattatttaattaatgaggaaagccatggtttattagcagagttggaagtcttcattggcaaacaaattcaaataaaaacagaagtgtattattcacaggaacaatttgatgttgttgtaatgtaacttccatttttaatatgttatattgacctcatattcattattcaaggtatcggtatggttaagaatattggaattttatatattgcgacagggcgttatcacgttctttgggaagatttctataaaagtgcggaaaagcattttctacccgagttacctaagaaatattttttattttctgattatgagggaagttttttaggagaggaaagtggaaatgttcacagaatatatcaaaaaaaattaggttggccttatgatacgttgatgcgttttgatatgtttttaaaagagaaagagcgatttaaagagttggattatctcttttttgttaatgcgaatatgatttttattaaagatatacatcaaaatgaagttcttgcatccgataaagagttaattatgattttacaaccttggtttatcggtttagatattgataaaactacttatgacagaaatccgttgtccacatcgtatattccttatggggagggtgaacattatgttatgggcagttttaacggcggtaaaacgtctgcttttttagagatgtgtcagcaattaaatgacaatatctatttagatttaaaaaaggacattattgcactatggcatgatgaaagtcatttaaatcattattgttggcgaaataaagaaaaaatatttattttgccggacagttatttgttggatgaagggcaacagtacttcccaagtaaaaagtctcattatattaatcccttatatttaaaaaatcatgatgttcggttagttatgagaaataagaatcattataggttcggggggggggaattacatgagagggattactgatgaacggatcgaatttaattggtcaatttttttgttgaatttaaatgtgtatcgtctctatttaaaagagagaattagggctgtatttaaagttctttgtaagaactaatattgttaaggtaggacaaaaaaacaagatgttaaacaaagtacaagaatctatacttgctccaaataatttagaaccggataatttaaaaaatacatttgatatgttgtctcatcgccagattgattatgcagatttgtattttcagctcagtcaagatgaaaattgggtgttggaagacggtattatcaaagaaggcggttttcatattgaccgtggcgttggtgtgcgtgcggtaactggcgagaaaacaggatttgcttattccgatcagattgatttggtcagtttacagcaatgtgccaatgcagtaaaaggaattgctttgccaaatcaaggtaatattattaaaccgattggttttaaagctgtaaatgcggttactcgttatcctgcagtaaatccgttaaatagtttgaataaagagcaaaaaattgaattattacatttagtagaccgtaccgctcgtgcatatagcccttatgtgacaaaagttgtagcgaatttaaccgctctttatgaagaaattttagttgtggcaacagatggtacgttagcagctgatgttcgaccgttaattcgtttatctatttttgtgatggcggaaaaagcgggaaaaagagaacaaggaagtgcgggcgttggggcgagagtaggacttgattggttctttgagccttataagggcgaacaacgtgcgatttattttgcgaaagaagcagcacgtcaagcattggtgaatttagacgctattgaagcacctgccggcttgatgccggtagtgttgggcgccggttggccgggtgtattattacacgaagctgtggggcatggattagagggtgattttaaccgtaaaggaagctcattgtttacaggaaaaattggggaattagtcacttctccattatgcactattgttgatgacggcactctaccgaatcgcagaggctcgttgacaatagatgatgagggcgtgccaagtcaatgtaatgtattgattaaagacggtgtcttgcagggttatatgcaagataaaatgaacgctcgcttaatgggtgtgaaaccgaccggaaatgggcgtcgtgaatcttatgctcatttgcctatgccaagaatgactaatacttatatgttagcggggcaaagtaagtttgaagatttaattgcttcggtcgattatggcatttttgcaccgcactttggtggtgggcaagtggatatcgtctccggaaaatttactttttccatgtcggaagcctatttaattgaaaaaggcagaataaccaagcctattaaaggtgcaactatgatcggacaaggaattgaagtgatgcaacaagtatctatggtagccgataatatggaaatagaccatggcataggtgtttgtggtaaagatggacaaagtgttccggttggcgttggtcaaccggcttgtaagatagagcaaattaccgtgggcggaaccgcttaattaaactatggtgaatttgtgatttgttagataattaatttttatagagaatatagacagtgactgaaacgactcaatcaaatttgcaattggctcaagcatataacgaactaccttatacttctaaagtttttgctgcttgtcaacctactcgtttacatgctttagctaagattaaagggcttttaccccccccccttagaaacagctaaggtgctggaaatcggttgttcttttggcggcaatttattgccctttgctattcgacaccctaatagccagttagtcggtattgatttatctgaataccaaattaatatcggtcagcaaatgatggaacaggtcggcgtgaaaaacgtagagttggttgctgctgacattagccaagtgagctttaatattaagtttgactatattatttgtcatggtgtttttagctgggtgccggaagcggtacgccatgcaattttaaaaaccatccaagagtatttatctcccaacggtattgctcatattagctataatacctacccaggctggaaaattcgagatgtcgctaaagagctgatgtgttttggaagcaatccgaatttaagcagtttggagcgtatagaccaatcttttgagttattaaaatttacctcttccattttgcaacgaaagaatgctgacttatataaagtattatcgcattcatttcaagaaatacctgataaagataaattttacgtggctcatgaatactttgaggattttaaccaacctttctatttcagggaatttatcagcaaacttgaggcataccatttagcctatttaaccgatagttcttttcccgctatttattctgatattcattttgaaaatgatgagtatgagaaagtatgtgcctattttgactaccgcttggaagccgtagagcaatttattgatttcctgaataaccgttcttttagacacagcattattacccatcaacaaaatttggcggacaaagggattaccaataatatcagtcaatacaatcattgccatcatttctatgatatctatttcagaacagatgtgcgttatagccctgcgactgatgataaggaagcgcattggcagttgctggacataggtgcggaaatttcggataccccattaaataatttattatgtacttatcttcaagagcataacaatccttgtaaaattggcgatatttgtgagtatgccaaaaaattccccgaatatgacgaaactgaactttacaaattaattctttctattatttattctaatcatgtttatttatgttttgagccagagacatcgaccggctatgacagcaaacccaaattgtttgagccgtaccgaagattgattgagttggtcagacataatcccaatgttaccggcttgtccaatcgatactatcaggtactcaacttagatttcttgccgcaatatatcgcacaatttctcgatggcaccagaacagtcaaggatttaatcaaacaattgcgagaggacattgaaaacaataccattgtccttcatgatgaaaacggcaatgaactttcgaataaaaagattaaagataaagacctcaaagaagtgattgttcggcaattggacgcactcaaggagtacggttatttcacggaatataaatagtactgtgtaaattgtccaatcgtgagatagtgtagggagcgtatttaatattgcattgaatacgctctatttgtttaaatttaaactttaaaatcaggtgctaaacaaggttggattttattgagtatttcttttacaagacgtggtgttgctgcaacgatatgactgtcagtgaaatatttatgaccaccgtagaaatcacatactaaaccaccagcttcacgtaaaatcagatcacctgccgtaatatcccaaggtttaacgcccatttcaaaataaccgtcaacacgattagccgcaacatagcaaagatcaagtgcggcagaacctgcacgacgaaaatcagcaacattttcagcaaggttactcatcatagcaaattgggttggcatgagagagggttttttgaatggaaatccggttgccaaaattgcaccttgaaggtcacgtttactgctatcaacacgtaaacgtaattcattaattttcgcaccttcaccacgcacagcggtgaataattcattgcgaataggatcataaaccacgcctatttcagtgcgaccttttacacggacagcgatagatacagcaaagtgcggtaagcctttgacaaagtttgtcgtaccatctagtggatctattacccattgaatatcgttgttttgtccttcgtgagcaccgctttcctcagtaataattgtatgttcgggataagatttgcgaacaacctcgataattgctgcttctgaggctttatcaatattcgtaacaaaatcatttatacccttttgcattgtttgaatttcatcgcggcgttcataacctttaacaattatattacccgcttttcgtgccgcacgaatagcgatatttaacattggattcatctctttccaccagatttcaaagaacacatggggtgggattatagtgaattttgcctataaaagcgagtagattttaggtttcctaacggttttttagggatcaaataacttttcgtaaattataggggctatgctaaaatacccacaattttaagtaaggtaaaagtcttaatgttggaaaatatcaaaattgttttagttgaaacttctcacagtggcaacattggttctgctgctcgtgcaatgaaaacaatgggactaaatcaattatgtttagttgcacccaaacagggaattgatgaacaggctgttgcgttagctgcgggtgctgaagatgtggtaaaaagtgcggtagtggcggacagtttttctcaagctgtagcggactgttctcttattattggcacaagtgcaaggttaagacatttacaaagtaccttaattgaaccgagagaatgtgctgaaaaagtcatacaaagtttgtcatctcaaaaagtagccattgtttttgggcgtgaacgagttggactgacaaatgatgaattattaaaatgccattatcatttaactattccggctaatcctgaatattcttcattaaatctggctatggcagtgcaattaatcagctatgaacttagactagcttggcttgcctcgttaaaagaactgaaacaaccgttttctgtgatagcaaataactatccgacatttcaagaattagagcatttttttgcacataccgaacaactctatcaacaacttggttttattcaaaatcaaggggttatgaaaaaattaagacgtttatatcagcgtgttcaacttgaaaaaaatgagttgaatattttgcgtggtatgttaagtgcggtagaaaagcgaattaattgcaaaaaattagaagttgactaatttagtaggattagtaatatatccgctcaatgtggatctaaaggatattgagaatgaaattaacatcaaaagggcggtatgcggtaacagctattttggatattgcgttaaatgctgagcttggacctgttagtttagcggatatctctgaacgacagcatatttccctttcttatttagaacagctttttgctaaattacgccgtggtggtttagtgaaaagtgtgcgtggtcctggtggcgggtatcagttaggattatctactgatcagatctccattggcatggtaattaacgcagttaatgaaaatattaacgttacaaaatgtttggggaatggcgattgtcaggggggagtaaaatgcttaactcattctttgtgggaagaattgagtgtacgaattgaaaatttcttaaatgaaataacgattgcagaattagttgcaaaacaagccaagtgaaatgagcagtacacgtttgagatagtgataaaaccggctaaaagtgcggtacaagaaaagattttttaggagagagtaatgaaattacctatttatttagattatgcggcaacttgccctgtggatgaacgtgtagtgaagaaaatgatggagtttttaagcattgatggaaattttggaaacccggcatctcgctcacataaatttggttggcaggctgaagaagcggttgatgttgctcgcaatcatattgctgatttaatcggtgcggacagtcgtgagattgtttttacttctggtgcaacagaagcggacaaccttgcattgaaaggagtgatgcgtttctatcaaactaaagggaaacatcttattacctgtaaaactgaacataaagcgatcttagacacttgtcgccagcttgaacgtgaagggtttgaagtgacttatttagatcccaaatcagatggtttgatagatttagaggaattaaaatccgttattcgtgatgacacggttttggtttctataatgcacgccaataatgagattggtgtagtacaggatattgctaaaattggtgaaatttgccgtgaacgtaaggtattatttcacaccgatgcaactcaatccgtcggtaaattgcccattaatttgagtgaattaaaagtagatttactttctatgtccagtcataaattatatggacctaaaggtataggtgctttatatgtttgccgtaaaccacgagttcgtttggaggcaattattcatggcggcggtcatgagcgtggtatgcgttcaggaaccttacctgtacatcagattgtgggcatgggtgaagcatatcgtattgctaaagaagaaatggcaacagaaatgccacgcttaaccgctttgcgtgatcgtttatataacggcttaaaagatattgaagaaacctatgtaaacggttcaatggaacaacgtttaggtaataatttaaatattagttttaattacgttgaaggtgaaagtttaatgatggcgttacgagatattgcggtatcttccggttctgcctgtacatcggcaagtctcgagccttcttatgttttgcgtgccttagggttaaatgacgaattggcacatagctcaattcgttttactgtggggcgttatactacggaagaagaaattgattattctatcggtttagttaaaagtgcggtgaaaaagttacgtgatttatctccactttgggatatgttcaaagagggtattgatttaaacagtattgaatggactcaccattaatagaagagtttagcagtttgttgggtaggtttatcgcttacccattttaagaaatgagaaaaaataggaacgaaaaatggcatatagcgaaaaattacttgatcattatgaaaatcctcgtaatgtaggttcttttgataaaaaagatccgacagtcggtagcggtatggttggtgcacctgcttgtggtgatgtcatgcaattacaaattaaagtaaatgatgaaggtatcattgaagatgctaaatttaaaacgtatggttgtggttcggcaattgcgtcaagttccttaatcactgaatgggtgaaaggtaaatctttagatgaagcccaagcgattaagaatagccaaattgctgaagagttggaattgccgccggttaaagtgcattgctcaattcttgcagaagatgcgattaaagctgcaattgctgattataaagcgaaaaaagctgaatagctaaagaagattaaaggagtaatgaggtgcatataattttaatattaagccacattattccttttgtgtttagttccctttagttggatttatgtttagataggtagttaaatttctagcagttataatgagttgagaattaactatattgattaaggagaataaatgagtatcaccttaacacaagcagctgcaaaccgagttcgtacttttttagaaaaaagaggaaaaggaataggtttacgtttagggattaaaacgtcaggttgctcaggcttagcttatattttagagttcgttgatgttttaaatgaagatgatgaggttttcgagcaagatggcgttaaggtgattgtggatcataagagcttagtctatttagacgggactcaactggattttgtcaaagagggactaaatgaaggctttaaatttagtaatccgaatgtaaaagatgaatgtggttgtggtgaaagtttcaacgtataggcaggcatatatatgataaatccatttgcgttatttgatttggaaattgattttaatcttgatcaacaaatactctcacagcgttatttaacgctacaaaaatctttgcatcctgataattttgctcatagatctgcccaagaacaacgtttagcactgcaaaaatctgctgaaattaatgatgctttacaaatactgaaagatcctatcagtcgtgctgatagtataatcaatttgcatcttggtgaacaaaatatagagcaaaaaactaatcaagatatgatgtttttgatgcagcaaatggaatggcgagaacggttggagcaagttgagcaacaacaaaatatggataagttattacacttctcgcaagaggtcgagtgtgtacaacgtgatattttagcggagctacaagaatttctggcacaacaaaattggcaacaagctcaattgctaaatgatcgtttacgttttattaaaaaattatttgttgaaattgaacgggttgaagaacagttagctggtttttagctcagtaatttatttagaaagttatgacgagataatagagtatggcattacttcaaattgcggagccagggcaaagtgcggcaccgcaccaacataaattagctgtaggtattgatttggggacaacaaactctttggttgcagctgtacgtagtggaagtagtgaagttttgcgggacgaacaggatcgcttgcttattccatcgatagttcatttaacagaagatcaagtgattgtggggtatgaggcaggtcaacttgccagtcaagatccgcaaaataccattatttccgtgaagcgtttaattggacgtagttgtactgatgtacagcaacgttatcctaatttgccttatcaatttagtgcaactgaaaatggcttacctctattaaagacaagaaggggattattaagtccggtagaaatttcagccgaaattttgaaaaaattgaccgcacttgctgagcaacgtttgggtggagaattaactggtgcagtgattactgttcctgcttattttgatgatgctcaacgacaaagtaccaaagatgctgcaaagttagcaggtttaaaggtattgcgtttacttaatgagccaaccgctgctgctatcgcttatggtttggatagtggacaagaaggtgtgattgctgtttatgatttaggcggcggtacttttgatgtgtccattttacgcttatctaaaggtgtgtttgaagtgcttgctaccggaggtgacaccgcacttggtggtgatgattttgatcatttattagcggagtggattgtaaaaaaatcaacaatcgcacctcaaaatgatcgtgaaaaacgtcaacttattgaagtcgcaaaccaagtcaaagttgctttgactacgaacgataaatgtttgatttcctatgcagagcaaaatttggaaattatgcgtgatgaatttaattctctgatttcaggtttagtcaaacgttcattattagcttgtcgtcggacgctaaaggatgccaatttaactccatcagatatattggaagtagtgatggtgggtggttcaacgcgtattccttatgttagagaacaagttggtgagtttttccaatgtacaccgctgacttctattgaccctgataaagtggtggcattaggtgcagctattcaggcggatattttagtaggaaataagcctgatagtgaaatgttattgctcgatgtgattccattgtcattaggtattgaaactatgggaggcttggttgagaagattattcctcgtaatactactattccggtagcaagagcacaggaatttactacattcaaagatgggcaaacagctatgtcggtgcatgtgttacaaggtgaacgtgaaatggttactgattgtcgctctttggctcgttttactttacgaggtattccggctatggtggcaggtgcagcacgtattcgagtcacttatcaagttgatgctgatgggttattaagtgttactgcagtggaaaaatcaacaggagtacaagcatcaactcaagtaaaaccttcctatggtttaactgatgatgaaattgctcatatgctaaaatcctcaatggagcatgctaaagaagatattcaaactcgtttactaacagaacagcgtgttgatgctaccagagtcattgaaagtgtttattcggcattacagcaagatgaagatcttttagatgataatgaattaagtgcggttaaaaatgccttagtttcattacaaaaattgattcaagaagaagatagccttgctattaagcaagggataaaaatgcttgatcaagcaacgcaagaatttgcctctcgccgtatggataaatctattcgtcgagcattaagcgggcaacatattgaacatattaaataaaggaaagtagaatgcccaaaattgtttttttacctcatcaagatttttgtcccgaaggaatggttgttgatgctgcaccgggagaaaatctattagacgttgcacataatgcaggcgtggaaattcatcatgcctgtgatggctcttgtgcttgtaccacttgccatgttgttattcgagagggatttgacagtttaaatgagacaacagaacaagaagaagatatgttagataaggcttggggcttagaaatggatagccgtctttcttgtcaatgtgtggtcggagaggaagatcttgtagtagaaattccacgttataatttgaatcatgctaatgaagcggctcattgatccatttatatcaaggtgcatttagcaccttaattattatgctcaaattatataagttatatccaattattctctgctttttgagcgaaaattcagtaatatacaggctttattctcaagtaaaggggatataaatgaaaatccaacatttaattaagcaacatcaacttggcttattgtttcaacaaggctcctttggtttagaaaaagaaagccaacgagtttatcaagacggttcggtagtaacaaccgaacaccctaaatgttttggtaacagatcttaccatccctacattcaaactgattttgcggaaagtcagctcgaattgatcacgcctcccaataaaaatttagaagatagtttaagatggttatccgctattcatgaagttgttttgcgttctttgcctgaggatgaatttatttttccgttgagtatgccggcaggattgccttcagatgaattgataaaagtcgctcaattggataaccctgaagatgtggcatatcgtgaacatttagttcagtcttatggaaaaaataaacaaatggtcagtggaatccattataactttcagttggatccagcacttattcaaaccttatttaatttacaacaagaacaaaaaagtgcggtagattttcagaataatttatacttgaaaatggcgaaaaattttcttcgctatcaatgggttctattgtacttattatcagcgacaccaacagtagagagtaattattttaaaggtagttcgccattaggaaaaggtgaatatgttcgcagtttacgttcaagcaaatatggttatgtgaatgatcctgaggtcattgtttcttttgatagtttagaacaatatgcagaaagtctggagcattgggttaaaagcggaaaactgatagcagagaaagaattttattccaatgtgcgtttacgaggtgcgaaaaaggcgagagatttaattcaaaatgggattaaatatttagaatttcgcttgtttgatctcaatcctttcgagcaatatggtatgagccttgcggatgcaagatttattcatcattttgtactattgatgatttggcttgatgaaatgccagatcaacaaggtgttgaactggggcgtagccgtctagcggaagtagctctagaaaatccgttggcacaaactgcctatcgagaagaaggtgagtggttacttaatcagttaatcagtatgttgcaaagtatcggagcagaccaaagtgcggtgagttttgtccgagaaaaattagctcaatttgctgatcccgggttgacgttatgtggtcgtttagtccaagaaattgagcagaaaggcggttatcaaaaattaggtgcggagttygccagacaatataaagcaaaggcttttgagcgtttttatgctttaaccgcttttgataacatggagctttcaactcaagccttaatgtttgatttaattcagcaaggtattagcgttgagatcttggatgaacgagatcagtttttacgcttacaatttggcgaacatgttgaatatgtcaaaaatggtaatatgacttcgaaagatagctatatttctcctcttattatggaaaataaagtggttacgaaaaaagtattggaaaaggcggggtttaatgttccacagagtcaggagtttacttcagttaaacaagcgatagccggttatagcctgtttgaaaaaagagcggtcgttattaaacctaaatctactaactatggcttggggattacaatttttcagcaaggtgtgaataatagagaagattttgccaaggcagtggaaattgcgttccgtgaagataaagaaattatggtggaggattatttagttggtactgaataccgcttctttgtgttaggtgaggaaacgctggcagttttattacgtgttccggcaaatatagtaggcgatggcattcatactgtggctgaattggtagctcaaaaaaatacgcatccattgcgtggtgatggtagtcgtacgccattgaaaaaaattgcattaggcgatattgagcaattgcagttgaaagagcaaggtttgactgttgagagtattccagctaaagatcaaactgttcagttgcgggcaaattctaatattagtacaggcggtgacagcattgatataactgatgaaatgcatttgagttataaacaactggcggtggggattgcaaaagctatgggggctgctgtgtgcggtgtggatctgattatttccgatttgaaagaaccggcacagcctgatttaagttcttggggcgtaattgaagcgaattttaatccaatgatgatgatgcacatcttcccttatgccggacaatctagaagattaacaagaaatgtgattaacatgttgtttccggaagtaaagtaaataatgtttttcgtaaaataggcggtttttagactgttaatgataagggctggtagtttaccgagaaatttgatttgctggtgtaatggaaaaaatggttgctaataatatatttttgacgttattagcaacgattttgtctattatgctactgcttatggtaagcaattatagtgagtcccccaacaaaacagattctaatgcaatttcgatcatttcattgaaagttaattgtcgctcttctgcactggtttgttcatgcgtacggatatgatcagaaacagtacagattgttaaggctttggctttaaattcagctgctacaccataaatgccggcagcctccatttccacacctaaaatgccatatttttccatgacatcaaacatttccaggtctggtgtataaaataagtcggcggaaaacaagttacctacttttacatcaattcctttattttttgcagcctgtacggctgcttgtgccatgccaaaatccgcaatggcagcgaaatcgttatctttgaagcgaatacgatttacttttgagtcggtacaagcaccaagaccaataatgacatcacgaattttgacatccatgttgactgcaccacaagaaccgacacgaataattttttttacgccatattctgtgatcaattctttggcataaatggagcaagacggaatacccattccatgtcccatcactgatatttttcgtcctttgtaagtacctgtatagccgagcatattacggatatttgttacctcttgtgcattttctaaaaaggtttctgcaatatattttgcacgtaatggatctcccggcattaaaacaacatcggcaaatgcaccggctggtgcgttaatatgtggcgtcataaatgtgtccttttgttgattaaaatattatttttccttaaagcaataaagcaatcgttttcttttacctaaaatgaacacaccacgaaaggtcatggtgtgaaatatggatgacggaattgaaccgcacttttacagtgcggcaccgcttaatccaataaatagacctgcaattgttgcactcattaagtttgctaatgaaccggcaattaccgctttaatacctaagcgagcaatatcaccacgacgatttggtgccattgcccctaagccaccgattaaaattgcaatagagctaaagtttgcaaatccacagagggcaaaagtaataattgctttagttttatcacttaattgcaccgctgcatcagctgcaaggtatggtacaaaatctaaataaccaacaaattcattaattgctaatttggttccaatcatacgaccggcaatttccgcttcttcccaaggaaccccaataatgaaggctaacggcttgaaaacccaaccaaagatcatgccaagagaaagtccttcttgaccaatccagtttccgatagtgccaagaattccgttaagtaatgcaattaaagccacaaatgcgatcaacatcgcacccacatttaaggcaagttgcataccagatgatgcacctccggcggcagcatcaagaatatttgttggtttttcttgttgtatttgttcgaaattatcattaaatttttcagtttgtgggataagaattttagcaaataacaatccggctggagcagccataaatgaagctgcgattagataggttagaggtacacccattccggcatatccagccatgactgaaccagcgatagaggctaaaccaccgcacattactgcaaacagctctgattctgtcattttgctaatataaggtttaatgactaagggggcttctgtttgtcccacgaagatattggctgctgccgacatagactcggattttgatgtgcctaatgctttttgtaatgctccgccgatgattttaatcagccattgcattacaccgatatagtaaagtagggagattaatgcggagaagaaaacaatatttggaaggacgttgataacgaaaacaaaaccggctgagcccatagaaccatcggcttgtggcgctaacccattaaatagaaaacggatcccttcattaccataattgatgactgattgtactgctcctgcaacgctttgtagtgcctgacgaccaacgggaacataaagaataaatgcaccaaataaaaattgaattaatagtgcacctagcactgtacgataattaatcgccttacgattattagataaaagaaaggctattaataataaagcgaagataccgataatgctaatcagagaactcataatgtgaatatccttataggtgtgttaaaaatgcacgtattctactcggttttatataaaaaatcttgtactttctaagtgagttatggcttttttaaatttataaatattctttgttttggattaaatttaatttcgattatgattaacacaacgcaactgttgggtcgtaataatgaaaaaatttaatgagcttcctcaaaccccttgggctgccaaatctttgtgggaaatagaaacaaagtcgctattggtactatgtttttcactttccttgctcggtattggtgatggattgttggttttatccaatttaggctctgcaccttggacagttttgtctcaaggcattgctttacaagcacaatttagtgttggctgggcatcatttatagtaagtatcttagtaatgttaatgtggattccgttaagattaaaagttggttttggaacaattctgaatgttgttctgatcgcattatttcttggtttaagtatattttatatttctccgccgagttcccttttagcaaggttttgctatcttataacgggtattattttttttggtatcggaaccgcattttatttgacttgccatcaaggggcaggacctcgagatggattaatggttgggttatgtcatcgctttaaattaagaataggaatagtccgtactcttatggaggtttctgtttgttttttgggttttttgctaggcggaacagtaggaattggtacactattatttgctaccagtattggttggattattcaattaggggtttattttattatgaaacttaacaagtcggtctaagaaatatggcattattgccagtcttaattttaaagcatataatctttgccattttattctatatctaaataaacctatgatgagattaccaatcagcgtcacaatgcttgtgaaaaatgccgagaaatatttggcaaaaagccttagttctttgaaagatttccctgaaattattgtgttagataatggatcaacagatcgatctattgaaattgcaaaacaatttactaatgtcaaaatttatcattcacctttcattggttttggaccgatgaaaaatttagttgcaacttatgcaagttatgattggattctaaatattgatagcgacgaaattttacaaccccagcttattcaagagatttctcagcttaatttcgatgaaccccgcaaagtttacgcattgttaagaattaatcattaccgtggaaagccaataaaaacttgtggttggtatcccgactttgtgaaacgtttatataataaaaagttggtaaaatttgatgacaagcgagtgcatgaggcattagagattgcagatgatatacaggtagttcgcttaaagcatgaatttaatcattattcttttgatagtagtgagatgttgattaataaaatgcaacattacaccgctctttttgcggaacaacaaaaatatagaaagaaaagtagtgtattgtcagcaattgctcatggaatagttgcatttttcaaaagttatatattaaagagggggattttatcgggaggcgatggttttattatttcttttgccaacgccagcggttcttactataaatatattaaattaatggaagctaatcagagtttaacaactgctttaattataacaacttataatcgcccagatgccttagaggctgtgttagtatccgtattagcacagagccttttgccgaatgaagtaattatcgctgatgacggctcaacagaagataccaaagaacttattcaaaaatatcaagcaatttttcctattccacttaaacatgtttggcaaccggatacgggctttcgtgcagctgagtcgcgtaatagagcattgtctgttgtggaatcggagtatgtgataactattgatggggatatggttttacatcctcaatttatttctgatcaccgtaaagcggcagaaaagaatgtatttgtgggggggggaagaatattgctcactaaggataaaacgaccgcacttttacaatcatcagaacaatattcctcttttaaatggtatgaaaaagggcttgaaactcgttttgaaaaacgtttaatggcgttgcatattcctttcttgtctgaatttatccaaagaactaaaagagtgcattattacaagggtgtaagaagttgcaatatggcattctttttatctgatgctttagaaattaatggttttaataatgattttgttggttgggggcgtgaggatagcgaatttgttgctcgcttttttaataatggaggaaaaagaaaaaacatcaagtttgcagcgattgcatatcacttgtggcatcctgaagaagatagagaagccttgccagttaatgatgaattacttaaacgagcaattgaagataaattggttttttgttcaaatggattgaaccaaattaaattggattaaatattattctttatatttttgtaacgcacttttcagtagggagatgtaaataaacttgctttttagctaaaaaagagtacaatcttcaggctttttgtctatatatacagagaaaaaagtaagcattcccactcttttgatgtgggttttcttttagtttaaattagttagaggaaggttatggtaaccattcgtttatctcgtggcggttctaaaaaacgcccgttttatcaaatcgtagtagctgacagtcgttcacctcgtgatggtcgtttcattgaacgtgttggttttttcaatccgttagcatcaggtaatgttgaacgtgttcgaatcaatttagatcgtgtgaatcattggattggtaatggtgcatctttatctgatcgtgttgctagcttagttaaagaggctcaaaaggcagcttaattttagcgattttataggtgaatgaaatggaacaacaaagaatagaagtcgttggaaaattaggttcaacatacggaattcgtggttggttgcgtctttattcatcaacagaacaagctgaaagtatctttgattaccaaccttggtttttaaaaatcaaggggcaatggcaaccaattgaattggaaagctggaaatttcataatcacgagttaattgttaaattaaaaggcattaatgagcgtgaggtcgcacaaactctggcaaatgttgaaatcggagtaaatttatccgtttttcctctattagatgagggggatttttattggcatgatttaatcggttgtcaagttgtgaatctacaaggttatgcaatgggtgttgtgtctgaaatgatggaaaccggtgccaatgatgtgttggttgtgcgtgcaagtacaaaagatgcttttggtaaaaaagagcggttgattccgttcttatatgaacaagtagttaaaagagtggatctcagttctaaaactattgaagttgactgggatgctggtttctaacctcaggtaatctgtaacgctttggcagtaacataaacacagaaggtaagtaaatgtggatcgggattattagtctatttcctgaaatgttcaaagctattacggaatacggagtaacaggacgagcagttaggcaaaacctgctggagatacaatattggaatccgagagatttcacctttgataaacataaaacggtagatgatcgcccttatggtggaggaccgggaatgttaatgatggcgcaacctttgcgtgatgccattcattgtgcaaagtctgtggcaggtgatggtgtgaaagtgatttatctttcgcctcaaggacgtaaactggatcaaaatggtgttcaagagcttgccagaaatcaaaaaatgatttttgtttgcgggcgttatgaaggcattgatgaacgattgattgaaactgaaattgatgaagaatggtcaatcggagattatgttcttaccggtggggaattgccggcgatgacgttgattgatgcagtcgcaagatttgttccctgtgttttgggtaaacaagcctctgcacaagaagattcttttgcagaagggctattagattgcccacattacacaagaccggaacaattaaacggtttaactgtacctcctgtattgatgtctggtaatcatgaggaaattcgtaagtggagattaaagcagtctttgcaacgaacatggttaagacgacctgagctattggaaagcctagctctgactgacgaacaaagtaagctgttatcgcagattaaacaagaaaacagttaatcagttaaatctaggatctaagaaggattactacaatgagtaatatcattaaacaaattgaacaagaacaattaaaacaaaacgtacctagcttccgtccaggggatactttagaagttaaagtatgggtagtggaaggaagtaaacgtcgtttacaagcattcgaaggtgtggttattgcaattcgtcaccgtgggttacatagtgctttcactttacgtaaaatatctaacggcgtaggtgttgagcgtgtattccaaacacattcaccaattatcgacagtattactgttaaacgtaaaggtgcggtacgtaaagccaaactttactatttacgtgagcgttcaggtaagtctgctcgtattaaagagcgtcttggtaattagtttattagacttatataaacaaccccttggatactccaaggggtttatttatagaaagattggcacgttttgaccttaaatcataaaatccaaccattaatagaacattaagtaatatgatgaatgcgcacatattacaataatgcaaaatgcaaaaattccacaaaatgatctgcccagtgtttttcatggtgaatttcatttgccatcattcgtaagcgaatgttatctaatggatgacctgtgcgtaataaggcttggtaataatggagtgtgcaatcaatataggcttggttcatatttgaaataaataatgaatcaacatcatctccttctttagtgcctacttgaataaagactttactatttttatcaattggattgtggtggataaaatgcagaaaatctttttcactaaaccaagatgcgagagaaaaaacacctaaatgtccaaaaatttgtggatatgctgaccccatataggcagtgataattcctcccatggaactgccggcaagcaaagtatgttctttttgtggtttagtgcggtaatgttgatcaatgaatggtttaacgatctcaactacccatttgccgtattccatacctttcccaccgcactttttaatttccggtgacgagcctacgtcagtacgccaaggtccatattcatcaagacgatctacacctgaattatctatgccaacaataataattttaggaaattctttatggtgtttaatggttggaataattttccaagagtaacctgagtaagattctttactataaaaaatattttgtccgtcatgcatatagagtactgcataactatcccacgtatctgtgtaataatcttttggcaataacactcgaatacgacgagtgcggttatagtaggggacgtaaagaaaatgttcttccatttttaaataataattagtatttttcacagcaaaaaccttataaaagtaaaacaaagtgattttttaaatactttcacctaaatgaatattatatccgagattgatcatgtaattttcaggtacaataccttctatacgattaagtaattcttttgccgccacttcaccgatatttaagcgtggtgtgcgtactgtggcaatttgtgtcgttaaagataatccaacatttaacccatggaagcctgcaataccgatttctttaggtacgtcaattccttgacgttgacattcaaataacgcaccaattgctaaatcatcattggtacaaaaaatgccatcaatttggggatgtttttttaatgccagttttaattgttccgcacctaaagtaaatgatgagggttcttccgtgaggagactgtgaggtgtcagttgatgttttttcattgcttgttcgtaaccctgcatttttaaacgggtacgtttatccatacgagcagagaaatagacaatatttttatagcctcgtttaatcattgtttccaccatagactgtgctgccgctatattgttaaaccccaccacttgttgtaaaccgaattcgctggtatccataatttcgacaacgggaatatttgccacatctaacatttttagcgttcttgccgaatgttctgtttccgacaaaataagtccatcaatgttataagagagaagcgattcaattcgtttttcttctttttcttgacaataaccataatgggctaacatggtttgataacctgcttgatcggtaatattctcaatacctttaattacatcggcaaaaacatgatttgttaaagagggtacaagtacaccaatcgctttgcttttcgcattggataaaatttccggtgcacgattaggaatatatccgaagtgttctatagcttcggcaatacgcacacctgttttcggtgcgacaagacgtggatcacgcaaataacgacttatcgtcattttagtaataccaagatgagaggcaatatcttgcaaagtggggcgtttacgtttatcgggcattttttatcctaacataactttatttctgtccattttgccagcaatatgcctgttgcaacagaaacattcaagccgtgttttaatggattaactaatgacaaattaatcagttcatctgctttatccgctaatgattcagtatcagcttcactcagtacaaatgcaactttatcattgagttgtaattgcttaatggttttggcgtgtttatttgagcttagatgaacgatttgatagcctgcttgtcgcaatttaaccaatgccgtttcagtgcgatcaatttccagcgggtgaatatattccataccgccttctgccactcgcattgctactgcagaatgaagaagttcaacatcgtcaataacaaccgcacttataccataacatacacaagtgcggataattccgccaatattatgtggattacgcacaccatttaaaaccaataggcagtttttttgctgtggaatatctaaatagccgtgcaaagtaaatggacggcgttttttgaccaacatgcaaataccgccatgatgttcagtgccgctgactaaggctaactcgctattatctactacatgatagacttttttattgctggctaaatagctaaacaaatcccccactttatgtgccatttctaccgtagtccaaacacgcacaatactttccggacgttgtgcaaaaagggataaacaagcattttcaccatatactttcatttcctctgcacgatttttcttgatcttctccggtgcacgtggcgataaagggccagttttcttttcagtttttgcaactaaacttgaacgttttagcacaacttgtacttgtcctgtaccgtttggcttttccatagtggtattgataatatgagtgtgggaagccgtattttgtgtattttgagggcgagagtgccgattggataaagctcgctttgagttattgtcaacgtgcggtgattttgatgtagatttttcatatcttttgttgctgacaaagcgttcagtaaagcgtttttcattatttgcttgttgaaaaattggtttttttgtcttcatgttggatattaatttaaggttagaaaaagataaagtgagcaaaaaaacaccgcactttatagagttttgtgaacattataacgaaaaaataccttttttctaccaagttaccgactaaatattgtaaactagccagccaaacacaaactcgtagagaagtgaattatgttgatcaataaaacaaaacgggcgaaacaaaatttggagcggttaccttgtattcctttgcaagcagagcaagttgagtttatttatcattcttcagattttaaacaacagattattcagtgtattcgtcaagcaaaatcaagaatttatttcaccgcactttactggcaaaacgacgaggcgggacagcaaatcctagatgagatttatcgtgctaaacaggcaaatcctgaattagaggtaaaaattttggttgattggcatcgtgcacaacgtaatttacttggtgctgagaaaagtgccacgaatgcggattggtattgtgatgaacgcagtaaatatcagttggctgacgatcctaatatattttttggtgtgccaatcaatactagagaagtattcggtgtcttgcatattaagggatttgtgtttgatgatacggttttatatagcggtgcgagcattaataatgtgtatctacaccaacaaacaaaatatcgttatgatcgttatcataaaattgaacatgagagattggctgatatcttagtcagctttgttaagaattatttattcgatcctaatgtggtttatccgcttgattccggtgatcgtcctaaaaccaaagaaattcgtcagtatattcgtaattttcgtaaatatcttgccggtgagggacagtattatgtggaatcttccgtgaccttaaatgacagtttgacgatttgtccattatttgggttaggtgcaaatcataatttacttaatcaaaccattgaagatttatttcaagttgttgaggataagttaacaatttgtacgccttattttaattttcctcgtttattacagcaaaaagtacgccgtttgctggctaaaggaaagcaagtagaaattattgtaggtgataaaactgctagtgatttttatattcctccatcagagccttttaaaatggcgggagcattgccatatctttatgagaaaaatttgcgtcattttagtaaaaaatttaccaagcaaattgaacaagggcagttagttgtccggatttggaaagatggtgaaaacagctaccatctaaaaggcatttgggttgatgattgttatatgttgttgacaggaaataatttaaatcctcgtgcttggcgtttagatgcggaaaatggcttatttatccatgatccgaaacaacagttacaagcacaaattcaacaagagttgacctatattcgtcgaaatactactgttctaaaacattatactgagttaagtgatctgactcagtatccgaagccggtacaaaaaatattgaaaaaatttgcccgcattaaagcagataagttagtgaagatgattttgtaagggttattcaaagcacttcatttcaaatattaaccgatagatcggcgataaatttcgccgatttcttttgaactcttaccaaacaccttttctaattgtgccaaaaaaagctcaccggcagatattgcatcaataagtgcattatgaccgatatattcgggcaaattatatttattacgaatatggctaagttgataattattttcgttgtcctgacataacgaacgttcaatttttaaggtatctaaccaaaacagaggaaattgcgataaattatagcgaacgttcagataatgtaagataaaacgcttttctatagtggagccgtgagcaataagaatacgtccttgcatcagctcaaagagtttattcattgtatcatctagggtttctgccccatttagcatttgtggcaaaatatgattgataataacagtatcttctttaatttcttgttgctcggcgacgaattgatgccatgcttttgaaatatctaatgttaaattgtcaatgggaacggtagcgacactcaaaatattatccatcattgaattcagccctgtggtttcgaaatcaattactaagtaggaaagtgcggtcaaatctgtggaacttttggggtaaggcttttcaaataaccttttccattgcacgggtaaattatcttgattaataaagatttttcgctgtttttccaatttattcaacggatgaaatttgttgaggaaattttttatcatctcattattcctcgttgtgaaaaacgtatctctgccgcctcttgaaattgggcaattaagcgaaaagcatctttaaggtgatttcgttcaagggcacttaactcactgggatcgatatgattagttagttcttgctgttgttgcaatgcgtctgattgatatttaaaacgcatattgcagacaaattgatatacctccagtgcattattaagggtttctttattcagaataccttgcttgtaacaatgtctaaaacgctgttcagttgacatagtttgtgctaaaccggcagcaagtgcgtaaattcgtgcaagatctactaataaactgatagcacgttttttcaagttaagtttatttttatgttcaccttctttaataagaacaaaatttcggaaaatacttaatgggggttttactcgaatactgtttgccactaagaacgctaaaaagcgtttattgtgtgcgactaaatcgacaaaatattgctggagttgatctgccaaattaagatcaccgtaaatacctcgcatatccataaatacagaggcattgagcaaaccttctaattcagatgcaataatccaactacggaaattttctttccattcctgtagagaaacacaccagcgtgcatttattgccatatagttacccgtgcagtaaggatagccgcattcatgcaatccattgtttacaaatttagttagttgtacaaaatattcctgttcaagtgcggttaattttctttctaaaatgattgcattatcctgatctgataaagggtgcatttcataacgagcctgtgaacctgctacaacccaagcatagcgacaaggcggagttcctaattcatgttcagccatcatgagcaacttacgggcaaatgcatcagcgataagcgtcatcacgtgcataatattattataagcgacacctctctctaataaagcacggaataaatcccgttgctgtttagctatttctacaagcaaaggcagcgtatttgcttgaaaaatacggttaatgataaaaacagattgcatactgttttgttttacaagatctgtggcggttaaaataccttgaactttatcatcaacaatcaccggcaagctacgaatattatgttgcatcatcatggaaatagcttgtagtactaattcatcacccctaatcacaggaggattaatgttcatgatttctgtcactaacgtatttacatctaagccttgtgctacaacttttttggtcatatcccgatcatgaataatgccaatcaatttgttttgttgcatcactaaagcagaagaacggcgttgttcacacattctaatcgcagcttgttgtaatgtcgtattcgtatcaacaagagcaattttaggattagcaatatcaatcacttttttcatgaaaatatcattttgattttttaaaaagttattttttgccaaactgtttagtctttttcctgcatcagaagaaaagtaagaagcgtactcaggaaatttttttaaaagttcatttaagcgttgaaaagggatttgataaattaacgtattttccaacgcataagcctgatatttatcttgctcgtgatgattgaaaatactgaaaccaaaacaatcgccactttccaatcttgctcttaattgtcctgatttattgacttgctccactgatcccatacgcacaatatacaagttttcattattattgaggctatcgatttcatcatttgtgattagttcccctttggggatataacgaacttcaatattctgtgcagtaagacgaattaaatcatgaggtaaatgtgtaaaagggggaacctgtgcaataaataattcgatattgggaataagtgagctatccatgtgagacctttgttttatcgaaagtgagctacaactatagcagaaattaacccgacacagctgcatcgggctaattacatttagtatttttgagaagataattagtttttacgatttttccataatttaattaatcttctataacgctctgaggtttctttgatgagtttctcatcatcaattttaccagctaaccaatcagccgaaggttgtccaaaaattgttctgcctacagcaaacccttttactaaaggtgcgtttgccgacgctttaaacacattctcaaagactgcttcaggtgcgtctaagccaaggattaaaataccacggcaatgtttgtcatttttttcaatgacttgactgatgtctgcccaagtttttgcggatactcccggtaatttccaccaatccggtttaatgccgagagaatagaagtgggcaatcatatcggtgtagtaactttctttttgctccatatccgcaggcaaaatgatctccagtaataattcgtgacctgtacgacaacaagcacgataaacttcttttaatgttgcatcttgatctgcttttaactctgccttgtctgctggatgatagaatgctaaacatttaacgacatgttctgcgggccaactaatgagttgactacctaaatcaccatgctctaaacgcaatggacgagaagatggcatttctattggacgaccaatccaccattttttaccggtaatttcattgagtgcttcttgaccaaatgtggtatcagctaaaacgccggcattgccattataaatcccctctttttgagcggtttgttctgcggctttaagtaataacgttttgagtgttggaatacgtttcaaatctgcaccgcacttttcagccatatcaaccaattgtttacgatgatcaaaggcaaaaatacataaatcatgccattgttgcttgcgtgttgtaacacggtgtaaatggtttaattgttcgtctaagtccggtcgaggtaccgattccgcacgggagagataattatctaattcttctttagtcggcattgccggggcacaaccatggcgagagacgaccaacgcaccgcaagcatttgcataacgacaacattgctcccaactttcaccgttaatatagccacgtaataaacctgacataaaggcatcgcctgcacctaagacattcaaaacttcaacacgtacgccatatacattaataccaccgtcaatatgattcggaatatcgccctcaaagacagaacaacctaacgccccacgtttgcaaactaacgtagcgttactgactttacgtacattttttaatgcagttagcgtatcagttgacccaccagcaatatgaaactcctcttctgtaccaactaagacatcaaagtgatgtaaaacttcttgtaaagattgtgtaacggcttcagagtcaataaaacgagtttcaccatcacccaatgaagttaatccccaaagtacaggacgatagtcaatatccagtaaacgttttgttccattacgacctgcgtattcaagtgcggttaaaaccgcatggcgagtttttggatgggataaatgcgttccggtaatagcaagtgctttcgccgaagcaatatattcttcatcaaaatcatcagcggtgattgccatgtctgcacaattatcacgatagaaaattaatggaaaagtattttgatcttttattcctaaaatcactagagcagtcagccgctctttatccgtaatcaaatggctcgtatctacacctagacgctgcaattcctcacgtaagaaacgtcccatatgttcatcacctacacgagccaacatagatgattttacaccttgtacagctgttccataagcaacattacctgatgagccgccgagatatttagcaaaagagctcacatcctctaagcgtgaaccgatttgttgagcatataaatctacggcaactcgtccaagacaaataagatctaatgttttttcttttttcattgtgcttctccttgcgtgatgaagtcatcacaaaaaacggatatagaataaattattgtcttaaattgaaacatatatttcaaaaatgtctagaaataaaattaatatttgagatattgatcacaaagattagctatctcgctggtatataaagtcttttaagtaaaataagaatgaaatttccttttcaaagtggtataaatttaacttattactgagagaaatacaaaggaagagatagtatgcaagaacattctcaactcgttacattacaaaatgaaatccgttcacgctattcgactttgagtaaacgtttgaaacaggtagcacaatatgtccttgataatcacaatagcgtaatttttgatactgttgcgacgatatctgaacgtgccggtgttcctccttctacgcttattcgcttcgcaaatgcgtttgggtttagtggctttaatgaaatgaaacaaatttttcgtgaaaatttgattgaagaaacggcgaattatacggagcgtttacaagttttccgtcagctggaaccggaaaagagcgagcaacataatctgcaagatattttgaatatttttgcacaagccaataatcaagcactaaaacaattaagtagccaaactaccacaaaacagttaaaaagtgcggtagaaatattaaaaaatgcacagaatatttttatcattggattaaaacgttcgtttagtattgcctgttatttggattatgtgttgcatcatttagattgccgttcttttttaataaatggattaggcggtatgtttgatgaacaattaatgcaagtgaaaaacggtgatgtcatcgtggcggtgagtttttcaccttatgccaaagaaacgctggaaattgttagtgcaacctcacaaaaaggtgtcaaacatattgccatcactgatagtcaaattagtccattaattgcctccagcgatgttgcttttgtcgtgaaagaagcacaggtaagcggcttccgttcacaatgtgctacgatgacattggtacaaactttagcgattttattaggcttagaaaaagagaaagaaacacaaaattcttaaaaataacgattaagatttggtgataaatgtcagcaactaagttttgagataaatatcaaaacgatgatttttggtttggtgactgaagtgcggtgtttttttagcaagaaaatctgcgtaatcgggacgctttactaccgctcttttttgtgcgagcaataaggcaggttctaataacatatcagcatccaaatctgcaccgattaaatgttgaaaaatacgcatttcttttttaaccaatgcacttttttgtttatgaggatacatcggatccaagtagacaacatcagcaccttcttcactcgaatttaattcttgaatatgtgctatgtccagcaattgcatattcgcctgcatcatagtccctatttctacatcggcataagcacgcttcaagccgtcttgtaataacaaatggactaccggatggcgttcaaccaaacggactttacaccccaaagcagccagcacaaaggcgtcacgtcccaaaccggcagttgcatcaataactgtcggcagataattacctttgatccctaccgcttttgccacagcttcagctcgaccgcctccaaatttacgacggtgagccattgtgccggtcacaaaatccacataaacagcaccaagtttcggctcatctaatttgcgtaattccaagcgaacctgtccttccacttttgtttgcaccagtgctaaataactattaggatcgtgaatcaaacctttttgttgacaaagtgcggtaaattgcaccgcactttctgtttcacaaattaattggattttttgattaaccatacaccactttccatatgctctgtataagggaattgatcaaacaaggcggctttttcaatacgatgagttttagttaattcttgcaaattttcacataatgtatatggattacaggatatatataaaatccgctcatagttttgtactaattttactgttgccatatcaagtccagatcttgggggatcaacaaaaatggtattacattgataatcttgtaaattaatgccttttaagcgattaaatgtacgcacaccgttcatagcttgcgtaaagtcctctgcggacatacgaataatgtgtaaattatcaattttatttgctgcaatattaaattgagccgcacttacagagggttttgcaatttctgtcgctaatactttgcgaaagttttgtgctagggcaatagagaaattgccgttcccgcagtaaagctcaagtaaatcgccctgactatttttagtacaattaattgcccattccaacattttacaatttaccgttgcattaggttgagtaaagctgttttctacttggcgataaatatactgttgatttttgacaggcaaaatttcatcaacaaaatcttgctgtaaacaaattttttgtttatttgcacgaccaataatttgtacatcaaatccttgttttatcagttgttgtttcaattgagttgctgcctgtagccattcttcgttaagtgttttgtggtataacaaactgacaatgatcttgttgctcaaagtactgagatagtcaatttggaataagcgatgagttaaaatattgtgttgtttaagcaaaggcaataacgccagcatcatttggttaatcaactgactggcaataggaaattgatcgatacgaaaacgttgttttgttttttgatcaaacataatatgatagaaatcatcttgttcatgccaaatacgaaattcggcacgcatacggaaatggcttgtttcggaagcaaatacgtcaagcggtggtgaattaaaaggtgctagaagtgcggtcagcttttgttgtttttctgctaaaagtgcggaatattgttcaataggtaaacgttgcatgatcttcagtattgagctaaaaatgaaaaggtgcgaatttcgcaccccttttacttaatcttaagttattcggcagagaaatcatccggattgtcagcaccaacaacgcctgataatgtgtaaacacgtttactggcagaaatacgagtgcggtatttattccaagttttctcaaaatatgtttctgccgggcgttcaccacgacagaaagcaacgaaggctttttcctcttctgtcaccggcatacgcatgcctaaatctaaagccttaaatgcttgaccatattgctctaacgtttgagattcacgaatagtgtaatcaccatgacgagcaaaacctcgtggataatttttatcatcaaaaaaacgacgtgtaacactaaaactctctgccataatatcctctatcttattttgtaaaaatcggctcgcattaaatcaattttttgttatttttgcaataaacctttaacagtttctacataatccttgataaaaccgtctgttgtacgggatagaccttccgcatttactttatatttaccgttaatataaaattcaggtgttgctcttacgccaagtttttttgctaaggcaatttgtttgtttgtttgaacggtgacggcaaaactattaattcctccgtcaaactgtaccgcagtaataccgtttgcgagaaacacttcacgaatattgtctaaagtaggtgcttttcttttttcaataatcaattcaaatagaggcattttaactttttcttctatgcctaagagaattgctaatgaccaagcacgaacaatatcttcgcccatccaatcaacatgatattgtttgaaagtgacatctttgggcaaatcagctttaatttgttgtggaatttgatatgttttttcaaaattaaaacaatggatacaaccaaaagagaaaaattcaatcacttcaggttgaacggaacgaggctgctctagttcaatatactgttttccttcttgtaatgctaaggcttgagttgaatttaaaaagaaaaaagaggctaatgcccatagaaattttttcatgtaatactcctaatcaataatgccacgtgcttttaataaggctgttttaaaatcgtcttcataatcttttttgatgccgggaataggctcatttttatctgtaccatacatttttaggtgataaataataacctcgtcggttaattccgcaatgggcttatcaaaaccggtttcctccgcaattttttgtaaaacttggattaaatgtaaatccggattgttagaccaatagggctgtaaaagttccaacacttcgtttaaacgatgacatttcataaagttttccttattatttaacccaaacagccgataatcatacttgaaataggtaaagaagaaaatatggcaacaacaattagtgcagtaattttagctggtgggcaagctaaacgaatggctgggttagataaaggattacaactgcttcaaggtaagcctctctatcaacattgtttgcaaaggttaacccatcaagtgagtagtatttctattaatgctaatcgtcatcaagctatttatcaacaaagtggggtagaggtttttggtgatgaattggaggattttcaaggtcctttaagtggaatattgaccgcacttgaacgagctaatacggattttgtgctttttgtgccttgtgatagcccttttttgccgttgaatttatgtgaaaagttgcaaagtgcggtggagaattcaaaaagtttattagcttatgcaaatgatggtgaacgtgaacatcctgcttttagtttattgtccactcaacttaaattaccgttaagagcttatttgcagtccggtcatcgtcaaatgttacaattttttcgtcaacataagggtatttctgtggatttccgcttacaaaaacaggctttcgtgaatatgaacacattgcaggatattgaaaaatatcaaaatatttatgcttaattttttgttttaattattaattaccttaatttgagcataaatatatgaaaaatcattttttttactaagcaattagagtagacttcccctctgttgatatattacataggaataaaaaatgttaagcaaacaacaatcattaaaagaactcacatttcgaggaatgttattgggggcgttgatcactgtggtatttacggcttccaatgtgtatttgggtttaaaagtcgggttgacttttgcctcatcagttcctgcagcggttatctcaatggcagtattaaaatttttcaaggggtctaatattcttgaaaataatatggtacaaactcaagcatcctcagccggaacattgtcttccgttatttttgttatccctgctatgttgatgctgggatattggcaaggtttccctttttggcaaacattattgatttgtatttccggcggtatgctaggggtaattttcactgtgccgttgcgtaatgtcatggtagtgaaaagtgatttgccttaccctgaaggcgttgccgcagcagaagtattgaaagcgggtaatgatgaaatcggtggaagaggtgtcaaagaacttacaatcggtggtctgattgcagcggtagccgggtttttaactaatggtttacgtgtaattgcggatagtgcaagtctttggttcaaaggtggaaatgcaatttttcaagtgccgatgggtttctcactcgctctgttaggtgcggggtatttagtgggtatgattggcggtttagccattttattaggcatttttgttgcttggggagtagcagttccttactttacttctgtcgcacccatgccgtctgatgccgatatgataggttatgctttcagtatttggaaaaataaagtgcgttttattggtgtagggactatcggtattgcggcaatttggactttattggtgttaatgaaaccaatgattcaaggtatgatcgagtcatttagagctttgaaagatccgaatgcaaaaaatactgaccgcacttcccaagacttatctccgacaacgctgattttcaccacgttagtaagcgttgtattaattgtattggctttatatagctttataaatcctgtgggtattgaagccggcacggcgatcattttaattttggtttgcactttacttgctgtcgttatcggtttcttagtagcagcagcgtgcggatatatggcaggccttgttggttcatcatcaagcccaatttccggaatcggtattatttctgtggtaacaacttcattagtgttaatgcttgtgggttctgctacaggtttattagacacggcggaaggtcagaaatttttgaccgcacttacgctatttaccggttcaatcgtggtttgtattgcggcaatttctaatgataacttacaagatttaaaaaccggtcaattagttgaagcaacaccttggcgtcaacagtttgccttgattatcggtgtgattgtgggggcgttagttattgctcctgtattggaaattctttatcacgcctatggttttgccggtgcaatgcctcgtgaaactatggatccgagccaagcacttttcgcaccgcaagcaaccttaatgatgactatcgcaaacggtattttttctcataatctcgaatggaactatattttctttggtatcggctttggtgcggttttaattttcatcgacagcgtattgaaaaaggcgtctaacaaacgtttagcgttaccagcattggcagtaggaatggggatctacttaccgccgtcagtcaatgcaccaatcgttgtcggtgcattgcttgcttggttgattaatcgtcatttagaaaactttgcgaaacgtacaggcaaagatcttgctgatgtgaagaaaaaagcggaacgtttcggcacattatttgcagcgggtctgattgtgggtgaaagtttaatcgggatattactggcatttattgttgcaggttccgttacttccggaggttctgatgcaccgctagcattacatttagaaaactgggagagtctagctcaagtattaggcttaatgatgttcgctacgggtataacaatctttgcattacgtgtactcaaggcgaaacaataatattgagaaaattaaatagatatttacaaaaaacctccagctttttaaagcggaggttttttatacataatttagaaacgagaaaactaagtaatattcacttcataacaatacctaacgattaacgcacaccctgtttatctaatctggcgaaatctttacatccctgagcgttgccgttatcgcatgcttgaccgtagaatgctttagctgtagaaacatttttttgtgcccctcgtcctttttcatacatatcgccgagatagagttgtgcttctgcaatgccttgttcagcggcttttgtgaaccaatagacggcttgttgatagttttgagcaacgccttgtccgtttgcatacatcacgccgagatagagttgtgcttctgcaatgccttgttcagcggcttttgtgaaccaatagacggcttgttgatagttttgagcaacgccttgtccgtttgcatacatcacgccgagatagagttgtacttctgcagctccctgttcagcggcttttgtgaaccaatagacggcttgttgagagttttgcgtaacacctagtccgttcgtgtacataaagccgagcatagattgtgcttttgcagctccctgttcagcggcttttgtgtaccaatagacggcttgttgagagttttgtgtaataccctgtccaaacatatacattgtgccgagcacagcttgtgcttttgcatttcctttttcccccagttgtttgagtaagggaaaagcggcagaataattttgttgtttgtaaagttgagtagctcggtcaagtttttcgctattggtttcggcaagtgcagattgggcaacaccgaaagagagcaaggcgataagtagggatttttttaggttcattttatgttccttatttgacgattatttgaattcaatacacaaagtttgtggattgagaaaacattttcttcccgtttcaagaggggtgattggattcaaaatatttaaattagaatcaaataattgagagctgccattagcaatcattttattgacgatttcatccacctctttttgttcattaggattgatggcttttatattgtcgtaaacataaggcgaatctgaggtatctccaaaaaaattcttataaatatcaacagtaatttcaatacgatttgacatggttttttcctctgatttgattttatatgtggcgttcgctacctactatcaagtaggtaggatgtagagtatactttacatcctttgacgtcctcccctagctaaagcaaggagattcctaccagctcccacagcaagctgtgggctactctcggagggtttctgctgctgaccgccaatgcgattcacttcacagacgctacgggcacgtcctgccctgattatgccgtcattgagagtctaaagcgacctctgttagcagtaagaagtatatcatatttatgccttatatccacgccctaaaggacgtggttttacggcacgattagataaaggattgctaaaccctttgctcggtgtcgattggtctattgagtgttatttatacagcagtatattacaaaaaaactccggtttgaaaactggagttgtttagaggtattaggcaaaagtatctaaatattgatctgttatttgggagacttatttgactagcccgccacttgcttgtaagtcagcatgatacgaagaacgcacaaaaggtccgcaagcggcatgctcaaatcccattttttcggctttatcacggaaatcatcaaattcctcaggtggaacgtatcgggcaacaggtaagtggtggcgacttggttgcaaatattgacctagagtcaacatggttacaccgttatcccgtaagtcctgcattacctgtaaaatttcttcattggtttctcccaagccaaccataatgcctgatttggtagggatatgtggaaaaatggttttaaattctttgagtaattttaacgaccaattatagtccgcacctggtctgatttcacgatataaacgaggtacattttctaaattatggttaaaaacatcagggggattatcttttaatttttctaatgcttgctcaatgcgtccacgaaaatcaggcaccaaaatttcaattttaatacccggattaagtttacgaatttctttaacacattcagcaaaatgtcccgcaccacgatccggtaaatcatcacgatccactgatgtaataacgacataacgtaatttcatatcttgaatggtttccgccaatttttttggttcatccggatctgggggtaatggttttccatgggcaacatcgcagaatggacatcggcgtgtacaaattgcacctaaaatcataaatgttgctgtgccgtgattgaagcattcatgtaaatttggacaagacgcttcttcacatactgaatgtaatccatgacgacgcattccgtttttaatactgttaattttcgcagaatttgcaggaagcttgattttcatccattcaggtttttttaataactcctgatttggatcgatatttttaaccggaatgattgacgtttttgcagcatcacgatatttgacaccacgttccattttaaaaggggttgtcattaacagatcctaatttgttaataagttgttacatcattatagcccaataattgcgtaaagtgtgtaactaatttgggtgcaactttatcacattgagcttgttcagtgggtataaaatctgccatttggcacatttctaagcctatatagccacaaggattgatttgtctaaatggcgataaatccatgttgatatttaaggctaaaccatggaaagagtagcctttacgaatacgtaaaccaagagaacaaattttttgttcatttacatatacaccgggggcatcagctttcggataacttttaataccataatcagccagtgtgctaaccactgattgctcaagagcggtaactaattgacgaacattaagttcactgccgtttgctttgtgacgcttaatatcaatcagtacatacataatttgttgtcctaagccatgataggtaatttgtcccccacgatcggattgtaccacaggaatatcggttggattgagcaaatgttcaggtttacctgcttgtccttgtgtaaaaacagccggatgttgaactaaccaaatttcatcagctgttagcacatttcgagtatcagtaaattctcgcatttgttgccaaacttgttgataatcttggattccaagttggcgtataataagagtagtatctgtcattttctgtcttaaagtaccatgcgtacaccatcaattttggctagttcagtatagagaatttctacttgttcaatattttccgcaatgatatctacagaaattgaattataagttcctttgctactgatattttgacgagggttataatcacccttagcgtatttttgcgttaccataactacatcatcaattaaatctgctcggtttttaccaacgactttgaaagtaaaagagcaaggaaactccaacaaatcttttaattgtttttgtggaatgtcgttaagttttactgttttgtcagtcataaaatttccttaaagtgaaaatatgccggaaagtgcggtctgatcttattgtttttagttaaacaaaccttttactgttaataccagccagtcccaaagtttgctgaaaaatccgccttcttgaacttcagacataatttttaagtttgcacttgcaatatcacgaccatctaattgataaataattttacctacaatttgtccttttgctaacggagctgttaacattttttgattaagctcgtatcttgttttaacatcattctggcgacctttaggtaaagttatataagcatcttccagtaccccaagttgcactttgtttgtattaccgtagtaaactttttcttctacaatagattggtttgcctgtaaagatttgaaggtttcaaagttagcaaagccccattgtaacaattttttactttcaatttcacgacctttgtgagtagcaacgcccataacaactgaaattaatcgcatattgttattatttactgcagaggcaaccaagttataacctgctttatttgtatgtcctgttttcataccgtctactttgattgatttatcccaaagtaaaccgttacggttatgttgcttaattttattgaaggtgaattctttttcagcatagattttatattcttcaggcaggtcatgaataatatgacgcccaataatcgccatatctctggcagatgaatattgattatcatcatccaatccatgaacggtcataaagtttgtattttttaaaccaaatttagcaacatatttattcattagttcaataaaattacgctctgaacttgctatatgttccgctattgccacacaggcatcattaccggatacaatcactatgccacgatttaaatcagctactgatacttgttggtttaaatttaaaaacattttagatgaaccgggaaaattttcccccaagcactttcatcaatggttacagtgtcggttaagctaattttaccttgcttgattgcatcacctacaacataacttgtcatcatttttgttaatgaggcagggtgttgacgctgatccggattaaaggcagcaagaactgcacctgaatggtaatccatgagaatatagctttgtgcacttaattccggtgaagcaatgccatattgaatatcttgggaaagtgcaggtaatgaaattaatcctgacatcagtgcaatttttgtttttttcatcgctttttgtaacattttacatcctttaaaaattatttctcattgtaagagatggtgataaattagtgtaattggcggatttatttaacctatctttaaaaccttattgctaagatttaatgtttttacgtgttttagccaacgtttttgtacccggtccggaaatttttccatacgcatcaacatataatgattctacctttacttttgctatgccggcatgaatcattccaagctcttttgcggcagcttcagataaatcaataattcgttctttgctaaaaggccctcggtcattgattcttacgatcactttacgattattgcgtaaattagttacgaccacataagagtttagtggcaaagttttatgtgctgctgtataggcattattattaaaaatttcaccgtttgcagttttacgtccatgaaattttttgtgataaaaacttgccattcctttttgtgaataattttttgccttttcgtagggtagtgttgtatatctaacgcctttgactacgtaagtatagggctttttactcagtttttgatagactggcttagctccttcaatgccatataattttttcgtatccgcctgtattgacagcgaaactaaagccataaaaagtgcggtgcataatttaaatattttgtttgacttcatagtaataagtttaatattgattgtattatctaagataaatatttatttagttcctttgaaaaagttatttttatgtgtatgaatggacatgatcaaaccaaatccggccattaaggtaacaaaagaggttcctccatagctcattaaaggtaaaggtactccaactacaggtagaatgccacttaccataccaatattgacaaatacataaacaaagaaaattaatgtcaatgcaccacttaaaattcgtccaaaagaattttgtgcattaacaccgataattaaccctcttgcaacaataaagagatagatgagcatcagtattgtaaatcctgtcataccatattcttcacttaatacagcaaaaataaagtctgtatgtggttccggtaggaattcaagttgcgattgtgtaccttgcatccaacctttaccccaaatcccccccgaaccgatggctatttttgattgcataatgtggtagccagcacctaaaggatctttttctgggtctaaaagagttaagactcttgtgcgttggtaatcatgcattaaatagagccatacaattggagtaaaagcagttaagcccacaatagcaattaagatgaaccaccagttgattccggctaaaaatacgacaaaaatcccggatgcactgactaaaattgacgttcctaaatctggctgaatagctactaataaagtcggcactattattaataataaagcaataaaaatttcacttaatttaggtggaagaggacgttttcctaaatatgttgcaaccattaatggtactgataatttaacaatttcagagggttggaaacgaaaaatccctagatctaaccaacgttgtgctcctttacttgttgttccaaaaagatccactaacagtagtaaaattacgccaatgacaaatccataaggtgcaatacgttgataaaaccttggtgaaaattgtgccatcacaaacataacagtaaaaccgagagcaacttgaataattcggttgcggaacattttttcattgcctcctaccgcactataaagtacaagcaatccataggaggaaatggttactaaccctagaaaaagccaaaaatcaatatgcaaacgacgccacaaaatcagccaaatattttttttctccatcaactttttcctttttcatttttcctttttcattttgtgattgtacttgtggcaaacggatatttaaataatagtccataatttttcgaacaacaggtcctgccttactgctaccaccaccggcattttccaaaataacaacaacaaccattttgggatcgtcataaggtgcatatccgatgaaccaggcatgatcgtgcaatttattatcaagttcgtttgcattgtaagtttgattttctttcaggctgaaaacttgagccgttcctgattttcctgcaacaggataactgacatcaataaaagatttacgtcctgtaccattcggtgcgtgtattacattatacatgctttgttttatcgtttcccaaaataccgcttgaggttcagtaatatcttcgtaaagacgaggatcttgatagggttgcatttctgacccttcaattgctttcattaagtgcggagtattaaccttgccattattaactaaaactgcagttgctttggcaacttgtaatggggtggctgtccaataaccttgaccaattcctacagaaatagtatcaccctgaacccaaggtcgtttgtagcgtttttgtttccattcccgacttggcataagtgcggcggtttcttcttgaatatcaatacctgttggcacaccaaaaccaaagcgtttcatccactgagataaacggctaatgcccatgtcgtaagcaagttgataaaaataagtatctgaagattctactatagctttattcaaatcggtgtagccgtgccctgattttttccaatctctaaaacgtttggtggtattaggtaaaatccaatatcccgggtcaaatatcgtagtatttgtggtaattaaattttcttgcaagccagcgatagcaacgaaaggttttatcgttgaagccggtggataagcaccttgagtcacacggctatacaaagggcgattaggatctgtcagtaattgcttgtaatccgcacttgaaataccgccaacaaaaagattgttatcatagctcggggtagaaaccattgctaaaataccgctatctttaggatctaacactacaactgctgcacgaagattgcccaataaatttgcgatataacgttgtaattctaaatcaatcgttaagtgaatactttttccggcaatagcaggctgttcccttagtttgcgaataaccttacctctattattcacttcaacttcttcaaatcctactttgccatgtaagtcatcttcatagtaacgttcaataccgagcttgccaatatcatgagtgccggcgtagttggcgtatttttcatttttctttaaacgctctacatctttttcattgattttagcgacataacctagaatatgagtcaacggctcaccatacaaatagtggcgtttaaagtaaggcctaatatcgaggctgggatagtgatattggtttactgcaaagcgtgcgatttgttcttcgctcaaatctcctttaaggagaattggcatatatcgggatgagcgacgacgttcctttttaaagttctcaatatcatcatcatttaaaccaacgatatagcgtaactcttcaaaagtgcggtttaaatcctcaactttttccggcacaatatataagccgagaaaggtaatattttccgctaataatttgccgtagcggtcgtaaattagtcctcgagttggtggcaaaggaagtaatttaattcgatttccgttagatcttgtctggtaagtttcgtaattgataatttgtaaataatacaaattggtaaataaaagtgctgataaacccaatacacctagaaaggcgataagagcacgacgagcaaaaaggtttctctccgcctttttatctcggatcggtgtttgtagaggttgagagagtaatttttttaaattcataaaatattaaccgcacttattctcggtgataaggatgatttgtgcttaacgaccaagcacggtataaactctcagcaacaacgatacgtaccaatggatgaggtaaagttaaaggcgaaagagaccaactttgttctgtcgcagctttgcattcaggtgataatccttccggaccaccaattaagagtgcaacatttcgaccgtcatgtttccatgcttctaattgctgtgctaattgctcagttgtccaaggtttaccgggaatatctaaggtaataatacgacttttctgacaagcggataacatagctttaccttcttgttcgagaatacgtttaatatccgcattttttccacgttttcctgccgggatttctattagctcaaaaggcatatctttgggaaaacgacgttgatactcctcgaagccttttgtgacccaatcaggcattttagtgccaacggcaattaattgaattttcatagattaataagtgcggtcattatccccaaagtttttccagctgatacatttcacgactgtcagcctgcataatgtgtacaatggcttgaccaaaatctatcgcaatccaatctgcggtagatttgccctcttcgccaaaagtatcaatgccggcttgcttactttcatcaattaatttctgtgccaaagagattacatggcgacttgacgttcctgtacataaaatcatgtgatcggtaatagaagatttacctctaacatcaagggctaaaatatctgtgccttttaaatcatctaatttactcactagaaaatcgactaagttcattttttctcttctcaattgcttatggttatttgcttaaaagtgtgtaatgttagcatgatttgggggagctaggaatatcgtttgatagtgtaattgtatacaaagaacgctcttttacttatataaaaaatttttctatttataaatgatttctcggacagcgattggaagaaatgagcgtgtgtttattatttaggttcacaaaaatctcttatgtcagccatgccacatacattgaaagcacatctgcattggttttcactaatgttctttatcaagaaactgtacctattaatggtacagttgtgttttgtcaaaaatacaaagtgataatgtgtaattctaaatttttctaaatattaactacacgcatcgcgatatatttactataacctaaggcacataaaaaaaggcttgcttgaagtaagataatacaaggtcctgtggcgacgttgaaatgaaaactgagcaatacgccaaaaataccactgaatactgctgtgcaaacggcaattagcatcatataatcaaagcgtttagctaaaatatagcctgttatcccaggtgtaatgagcattgccaccactaaaataacgccaacaacttgcattgcactgatgatgactaacgctaggattaccagtaaaccatagtgtaaaaatttggtgttaagtcctgcaactcgtgtgtgacttggatcaaaacagtaaagcaacaagtctttgcgttttaaggcaatcaggataaatgccagtaatgcaatgccaatactttgccaaaattcttgcttaatgatacctagaatatttccgaacagaatgtgcattagatgttgatcggtttccactttggaaaacagcacaaaaccgaaagcaaacattcctgaaaaaacaattcccatcactgtgtcttctttgattcggctgttatctctcaaataacctacggaaactgcacaaaagatgcctgcccaaaatgccccaatcgcaatcggaattgctaatacataggcaagaataattcccggcaatacagcgtgagaaatggcatcacccattagtgaccagcctttaagtactaaataacacgataaaatcgcacacactgccccaatgataggtgcgatgataatagcttgttgcataaatggatacaccaagggctcggtaaaccacgctacaatcgtattaaacatttggcttctcctgatttgcaagatttggtgaggaagtcactgctttttgtgtacttcgcttacgtggaataagaccatatttgggagcaaaaaagaaagcaagcaagaagatgaacgtttgcaatgatacaataaagccaccagttgcactgtctgcgaaataactcaaatatgctcctagtgagctagtagtaccaccgagtaaaatcgaaataatcaacaggcgatcgaagcgatcggtgagcaaatatgctgttgctccaggtgtaatcaccatcgcaattaccaaaatagcccctactccttgtaaggcggttacaatgcatgcacttaacaaggtaaagaataaaattttgaattttaaaggcgatatccctaccgctttggcttgaatttcatcaaagaacacaagcattaggtctttccaaaagagtagcaacaatacaaatgatataccgagaataatagcgacttggatcatatcttcatcggcaatacctaaaatattgcccaaaacgatagattgtacgttcacggaagtgggattaattgaaataatcaacaatccgagagcgaagaaagaggtgaaaataaaaccgattactgcatcctctttgagtttggtcacgtatttcactgctaaaatggcaatggtggcaagtagcccggagaaaaaagccccgacggcataaggtaatgccaaggcataggcaatagcaacgcctgggacaacggcgtgggataacgcatcaccgatcagtgaccaacctttcagcattaaataagcggaaagaaaagcacaaaccgctccaatggcaccactgaccacaatcgctttaaacataaaatcataagaaaacggctcaagtaatagctctaacatcgcattactccgcatcttgaataaaatgttgataacgtaaaacgccaccaaacacacgagctaaattttcttgagtaaaagtgctttcgattgatccagcagcgagtagtgtacggttgatcatcaccgcttgatcgcaaaaacttggcacggtgctaagattatgcgttgaaacgagaacgagatgaccttcctgacgaagctgtttgagtaacgcaatgatggcattttctgtgccaacatctacaccagtgaaaggttcatctaataaaatgatttggctttcttgtgctaatgcacgagcaagaaatactcgttttttttgccctccagaaagctcgccgatttgtcgatctcgcaaatgagcaatattgactcgctccattgcgtctaaaacttttttcttgtcttgtgctttaggcatacgaaagaaattcatataaccataacgccccatcattacaacgtcataaacagaaacggggaactgccaatccacttcttcactttgcggtacataggcaattaagttttgttttaatgcccgattagcgggcatgttacaaatttcaattgaaccttgaggcttcactaagcccataatgcttttgaataaagtcgattttccacttccgttaataccgagcaatgcacaaatcgtaccaccttcaaggtggaaactcacatcgtgcaacgccgtatgaccattactataacgaaccgtaatatctctgacagaaagagaactgatgtgagttttcattcaattaccttattttttgaaaccattcacaatggtcgaaacagttacatttaataagtcgatgtaagttggtactttaccatcttttgtagaaagtgaatctacataaagtacaccaccgtattttgcattggtttctttagccacttgttttgctggcttatcagaaatggtgctttcgctgaacacaacagggattttgtgttcacgtacttttttgattacatttttgatttgttttggtgtgccttgttcttcagcattgattggccataaataaagctctttaaaaccgtagtcgtgagctaaatagctgaatgcaccttcactagttactaaccaacgttgtgaagctggtactttttctaactcagcacgtaatggtgcgtctaaagcaacgattttatctgcataggcttttgcattagcattgtaagtgtctgcatttttaggatcgtatttcactaaagcttcacgaatgttttcgatgtataccaaagcatttttggttgacatccaagcatgtggattcggcatacctttgtatggaccttcgtagatagaaattggatcaatccctttagttacaacaacagctggtttatccttcacttgggtaaagaaacgctcgaaccaacgctctaaattcattccattccaaagcaccaaatcagcagattgtgcttttacgatgtcttgtggagttggttcataatcatgaatttctgcacccggctcagtgatcgactcaacaacagcagcatcaccggcaacattctgagcgatatcttgaataacagtaaaagtagtaactactttaaattttgcgtaacttggtaaactgaatacagaacctaagattacacccataacaataagtaaacgtgacataatttctccttcgaattaatattagaaacaaatttgcatttcaagcaaactcggtcttgcatagtactgcaaaaataacttattgtaaatagcaataattatcaattaaagacattttattggtttgggtaaaccagctaattttgaagcttgttttgcgggacctcctgggaataaacgttgtatgtaacgactattgcctttatctgcacctagcttttgtcccaatgctttgactaacattctcattgctggtgaggttttatactcttgataaaaatcccttacaaagttaataatttcccagtgggcttcggttaattcgatattttctgattttgcaatggctatagcgacatctttattccactgattcatatctaatagatagccctcaacatcagtttcaatttgaacttggttaacacttaacatatgttactatttttgtccttttgatatataaaaagtaaaaagcccctattcaaggggcataaaacaagtttaatcaattattcatcacggttgaaaatacctagtaaattgagcaagctgacaaaaagattgtaaagtgaaacatacaaactaaccgtagctctaatataattagtttctcccccatgaatgatattgctggtttcatataaaatagccatagttgagaaaacgataaataacgaactaaatacgatgtgaaagccactcatattaaagaagaaacttgctatcatgcctataaccaatacgataaagagagcaagcatcatgccggataagaatgacatatcttttttcgttgttagcacataggccgagcatgtaaaaaatacacttgcagttccggctagagcaagaacaaccaaatcacctaatcctgagccaacataatagcttaaaataggacctaaagaatagcctaataaccctgttaaagcgaatgtagataaaagtccccaagcactgtttgctaacatattattgaggaataataatccataaaaacctatcaacatgacaccgaaatgaagtggagggagatttaattgcattgcactgaaggcgacaacagcagaaaaggccaatgtcaatgctaataaaaagtaggtgttacgtaaaaccttatttgttgccagtaccgattcttctttagtatcaacaataaaacgagattgcataaaagctcctaggttgtagttgtaaataaaaagtgaaaagctatttataagttaatggttagcaactttaatgtcaacatgaatatttttcagaaaagagtaacattgaagtaaaattaagtaaaaatggataaattatcgactcttaaaccataactgttatttttttagtttacttctatttctatctatattatattacgcctcgtcaagacggaggaatggtcgagtggttgaaggcaccggtcttgaaaaccggcgagggtttacgccctccgtgagttcgaatctcacttcctccgccatcaagttttagcaagtcgtaagttatgcctctgaaatcagtaacttacggcttttttatatcaggttaattgtcgtaataacttgcttaaaaatcaccgcacttattggtctgatagtttccgtagcaaacgatccatggctcgatagcttaatgcttcagctaagtggttttgtttgatatcagaatctccgtttaaatcagcgatagtgcgtgcaacttttaaaattcgatgataagcacgaacagataaaccgagtctggttaaagtattttctaaaaatagtgcatcttgctcagtcaacttgcaatctcgctcaatttctttaccggttaaataagcattgacttttccggctctagctagctgaatttctctgacccttaatactttttctttaacttgtgctgttgtttcacctcgatcttcggtattttgcaaagcaccttgtggaagtaaaggcacttcgatggaaagatcaaagcgatctaaaaaaggaccggaaagtctgttcaaataacgcaacacttgttgtggtgaagtgcggttgtgtataccggtataatgtcccgttggacttggattcatcgcagccactaattgaaaacgtgccggaaactgaatttttgcattcgcacgtgaaataattatttctccgctttctaaaggctggcgtaaagcatccagcactctccgttcaaattcgggtaactcgtctaaaaataatacaccgttatgagccaaagaaatttctcccggtttcggaattgttcctcctccgaccaatgccggtgatgaggcactatgatgaggtgcacgaaaaggacgttgtttccaattttgaaaatttaattcgttttgtactaaacttgttacagaggcggtttctattgcctcttgatctgtcatatccggtagcaagccagttaaacggcttgctaacatggttttacctgtgccgggcggtccgagaaacaacaaattatgttgtccggcagctgcaatcattaaggctcgtttagcatgttgttgaccaataatatccgtcagatctttattagattgaggtgaaaaatctaccgcactttgcatacataacgttgtggatgaaggtagcgaactgtcgtcattcaggaattgtacgacctccaataagttccgtgcaaaaaatgtttcctgttgcgaaactaaagaggcttcattagcattttgttgtgcaacaataagttgtcgtttagatttttgccctgccaaaatagcaggaatgacaccgtgtacgcctcttagttcacctgttagagctaactctgcaacaaattcaaattgctgtaatttttttgcattaatctgttctgaagccgctaaaataccgagtgcaataggcagatcgaaacgcccgccttcttttggtaaatctgccggtgcaagattaactgtaatgcgttttgcagggtatttgaattgagcatttagtaatgcactacgtactcgtccttgtgcttcagttactgttttttccggcaatccaacgagggtaaaagcaggttttccattactcaagtgaacttcaattgtcaccaaaggtgcttgtacgcccattgatgctcgactataaacaactgctaatgacataatttctcccaaatttttgagctaaaatataaaaaaagcagcgagtaaactgtacttactcactgcttttttgcgatccggatcgtaaaagtaaaaaagttttagctaaaaagcggagaaaaccactgatctaatttttcggataagcgttcgataccgattttattttgtgcggaaaaggcttcaacttgtacatcaccttggaaaggtaaaatcgcttctcgaaccatttttacttgcttacttctcgcactttgactcaatttatccgcttttgtgagcaataataaaaccggtaaatctgcggaaaccgcccattcaatcatctgctgatcaagatcttttagaggatgacgaatgtccattaaaataaccaaaccacctaaacattcccttttttgcagatactcacctaaagatttttgccactgaagtttcatttgttcgggaacagcggcatagccatatcccggcagatctaccagcttacaattgggttctacttgaaataaattgattaactgagtacgtcctggtgtttttgaagttcttgctaaatttttttgctgggtcaacgcattaagtgcggtagattttcctgcattagatcgtcctgcaaaagcaatctcaatcccactatcctcaggcaataccttgatattcggtgcactcattaaaaaatgggttttatgataatttaattttatgtttgtcattttattttcgcttaggtcgttgccaattggaaatatggcgttgtggaacacgagtaataaccaactcattttcttgtacatctttggtgacggttgttcctgcaccaatcgttgcaccgcttgcaattgttagtggtgcaactagctgactatcggaaccgacaaaaacgttatcgccaatcaatgtcttaaatttattggcaccgtcataattacaagtaataacaccggcaccgatattacaatgatgtccaacctcagcatcgccaatataagtgagatgatttactttagatcctttgccgatttgtgcttttttaatctcaacgaagttacccacatgagtatcttcattcaattttgcacccggacgtaatcttgagaatggtccaattttggcattattacccacaatggcatcttcaatcacagaataaggttttatttccacattatctgcaatcgtacaatttttcagtacacaacctgccccaataaacacattattgcctaatcgtaccgttccttcgataattacatttatatcaatttccacatctttaccatgagttaattcaccacgcaaatcaaaacgtgcaggatcagcgaaagtaacacctgcaagtaacaatttttctacttgcttacgttgataatgacgttctaaattagctaattgtaaacggttatttactccctctacttccataagatctttagcttgtaccgctacaactttgaagccatcttgattggcaagttctattacatctgtcatgtaatattcaccttgtgcattattattatctaaacgagctagccatttacggaaacttgcaccgtccgataccataacgcctgtattcacttccgtaatttttagctgctcaggattagcgtctttctgttcaacaattgccgttactgtaccgttttctcgaatcactcgcccataacctgtaggattgtctaaattaacggtcaaaagtgcgataccattttccggtttttgtgaaattaaacactcaagggtttccttgctaattaaaggtacatcaccatataacatcacaatattttcgtcatcttggaaaaaaggcactgcttgttgcattgcatgccctgtacctaattgttcagattggaatacccagtttacaggttcatcagccaaatgttgttttagtagatcagcaccatgtccataaattaaatgaatttgtgccgcacttaattttttggcggtatcaatcacatgtttaaccatcggtttacctgcaattttgtgcaatactttaggtaaatccgaatacatgcgagttcctttaccggcggcaagaataacaacgcttaatttgttcatgataaattttctctttgtcataataatcgatgtattttagcgtaaaacacatgaaaaaataatataatgttattatgtttagcaaacatacgttcttcttttatgcaaaaaaataatcactattatattggaattatgtccggtacaagtttagacggtgttgatatagccttaatggattttaatcaaagaccgcccaagctacttgcaagccattgtttctctatgccggaaaatttacgccaacaactcaccgcacttttaaaaaacggagaaattggcttacagcaattaggcgagttggatcatcaactgggattactttacgcaaactcggtacaacgtttcttagcacaaaatcaaatgaccgctgatagtattcaagccatcggttgtcatggacaaacgatttggcattcaccccaaggtcaatatcctttcactatgcaaattggcgatgctaacctgattagtgtactgacaggaattacgactatcgctgattttcgtcgcaaagatatggctcatggtggacaaggtgcacctttgtcccctgcatttcatcaagccttatttgcacaacccgatcgcattacggtagtgttaaatattggcggtatcagtaatatttcttgtttaattccggaacaagaagttattggttatgataccggtgtaggtaatgctttgatggatagttggattgaacaacatttaggggtgcctttcgaccaagacggtgaatgggcaaagagcggtagtgttcaccaagatttgctaaaagatttattggacgaacctttttttcaacaacttccccctaaaagtaccggacgggaattatttaatttggcgtggttgaacaaaaaactgaaaaaacatactgcactttctgcacaagatgtacaggcaacgttgctggaatttacggtacaatgcacggtgcaagagctggttaaactcactaatccgaaccatttgccttgtttgttgttggtttgtggcggtggtgcaaaaaacagacaactaatggctcgtttacaagcctgtttaccgcaatggcacgtagcaacaactacagagcatggtttatcggttgattatgttgaagccgccgcttttgcttggttagcgtatcagcgtataaatcatttaccctctaatttaccaagtgtaaccggtgctaaaagtgcggtcagtcttggcgttatttatccgaaataatcatgaataaacaaaatttaattaatcagttcgctcaactaattaccgagcaacccaatccactctcagtaaatttggatcaaatgtctgcacttgaaattgtacaattgatgaataaagaagatcagcaagttccactcgtcatagcaaaagcacttccggaaattgccgttgtagtggaaaaaatcgttgctgcttttcgtcaaggtggacgcttagtgtatcttggagcggggacaagtgggcgtttaggcgttttagatgcctctgaatgtcccccaacctttggtgttaatcatgaaatggtaaaaggcattattgccggaggagaacaggctatccgttatcctgtggaaggcgctgaggataatcaacaagcggcaatagtagatctgcaagcaatccaattatgttcaaaagatattttagtgggtattgctgcgagcggtcgtacaccttatgtcatcagtggattaaaatatgccaaagagatagggagctttaccgttgcaatcgcaagcaatccacaaagtgctatggcaaaaattgccgatattggcatcgaaactattgtcggacctgagattttaaccggttcaagtcgcctgaaatccggtacggcacaaaaattggtgctgaatatgctaaccactgcgagtatggttttacttgggaaatgttatcaaaaccttatggttgatgtacaagcaagcaatgaaaaactcgttgatcgagcgacaagaattattatgcaagcaaccggttgtgaacgagcgaaagcagagcaaacgctaacacaagcagataataatgcaaaactggctatcttaatgattttaatggatttagataagcaaagtgcggtggatttattagcgaaaaatcaagataaattacgccaaacgttagactgatttttcaccactacttttctactaacaaggctgtcagtacatttgagagatgagagagtttgtaaaaaataggcggagaagataaaataaagcggttcgaaactgtagattaaatctaactagttaatattgttcataaatattaatattcagtttataaacaaacattcggacatgaattgcaagctggatatgtatagtttgcaactgaaatatgatctcaaggaggttaaatgtctttattaaatatcattaaatcgtttttctcatctaaaaaggagcaagccatgccgaatattctcgtcatttcaggtcattcaaatttacagcaatccactgccaacagtgctattttaggtgaattggcaaataaccttccaaatgcagaaattcgtaaattagatgagctttatcccgatttcaatatcaacatcgaagctgaacaagcggcattattaaaagccgatattatcatttggcaatttccggtgaactggtaccatttcccagcgattatgcaaaaatggttatctgatgtgttcacttatggttttgcttatggttctgagcaaaaattaactggtaaaaaattgtatatttcttgtactacagcaagtccggaagaagcctatcaacacgatggtgcacaaaaacacaccattgaagaatttagttatgcttatcagcaaactgccgcactttgtggtttagaattttgcggtattattcattctggcaatatgctttatattccgggtatgaatacagaggaagataaagaaaatgtaattgcaaaagcaaaacaacatgctgaacgtctagtaagtgcggttaaataacacatcatgttaatagacaaaagggacataatgttttatgtcccttccttgagtcaaaataacgataacacttcatcatcacatcttttttaaaatctcaattttttctgtatttttttgaaaatctatatcgtataatgctcagtcggtttaacgataacattaaactatgtaaacattacaaacattattttttctaaataaggggtctcttatgagatacaaattatctttagtacttttatcaatgctgcccgcactttcccatgcgggggggggggggtaatttcaacttttacggcaaagcgggaattgatttaacctctcgatttgaaacgatgaaaataacggaaaatcacgatagtgatagaggttttaaattatcaattccggcaagttcaagacaaaacactttctcacccagtatcttctttgaaacgacttacaatattttaccgcaaacggaaattggtctcggactaggctatatcaaacgaaaaggctttgaccatattgcaatttggcctgtcgagggtagttctttatataacccccaaggacagtttcatctgaaagaaacctatagagtaaatcgttatgcttccctgccaatttattttattttgaaacaaaattatgccttaaatgcaaatacaaaattttatctaaagggcgatttagggtattcaattaataaaattcgtaaaacagtatatactctctatgaggatttatccttgggtagtagcacaggttacaaaaaagacagagattttattagtaataataaatctagaagcggtctttacttaggtttaggtttggggattgaatataaatctttcttagtagatattggatattatcatactcattcaaaaatcacttacaaagagcaaggaagttacgtatcaacaccctataacaacgatgcaatacgcttaacgcttggctttaaattctaaaaaataaaaaattaacggtcataaaatagatgttttatgaccgttaaacatattcgttaataatgtaatgctaaaaaaacatcaattattttctttaagtctaaattgttgattacggtgttgcacaaatgagtagatgaaatacaatactgtcgctgcaccgaaacagtaataaccgatccacactgccggcaacacgtcttttgccatgaaaatatacagagaaattgaaataaatgtgatgactaaagaaacagcttttgcataagcccaaggttgaatatccacttgcttagtgtattcttcgttgtatggtgtttccattggcatgatgcgaccgataattagcattactactacattcacaacaaataagatagcgattaagtggaaaaaatggatctcaactttaatcacaaatttacataggatataagctaccataccaaatactaaaccgaatttagccgcaatcgcagggacacgttttgtcagtaaaccaaccaccacaacactcaaaattggggcattaaaaataccttgtaattcttgtattaagaagaataaaccatccggtgcattggctactaatggtgcaacaatcattgccataatcgctaaacctgtaccgacccatttacccacgctaactaatttcatatcgcttgcatgaggattaatttgtgttttatatacattgcgggaaaataaagttaccgatgagtttaaggcactattaaaggtggataaaactgccccaacaacaactgccgcaaagaagccgactaacgcatctggtaagactaaatgaactaaattaggataagcctgatctggaatatctaatttaccttggtaaatatgataagcaatgataccgggtaaaatgattaataaaggtcccagtagttttaaaaatgcacataaaagaacacctttttgtccctcttttaaacttttcgcacctaacgcacgctgaataatggattggtttgtacaccaaaagaataaattagaaataatcattcctgtgaataatgttgagaaaggaacaacagaattatcgtcaccaatagaattaaatttatcagggtttgtttcgtaaatggtttttaaaccatgccaagcattaccatctcccacataagctaaacctaaaacagccactaaaattccaccgaccaataacccgataccattaatagtatcagatacagcaaccgctttgagtccaccgaaaattgcatagactgatccgagtattccgattccccataccataatccaaattgccgtagtcttatcaatgttgaagacggtagagacatcaaagagactttctaatgcaagtgcacctgtataaagcacgatcggcaacaatgaaataacatagcaaccgaggaacaataaagaggtgattaataatgttcctttgtcaaaacgtttttctaaaaattctggaatagttgcaatgccaagttttaaatacttaggtaagaagtaaagtgcaaacattgcaattgtaattgccgctaaaacttcccatgccattacgataaaaccttcacgataagccaaaccgtttagacccactaaatgctcggtagaaaggttagttaataacatagatcctgcaataaacgttgctgtcaacgaccgtccggctaaatagtagccttcagagttgctaagatcgtcttttctggtgtaccaccaagcaagcacagcaacaagggctgtaaatcctataaatgagataagagatagcatagaaattccttatatgaatgagtgtttctatcattgttgtaaacaacacatcgataaggtcgaatggtgacctttcttgaaatatatatttcaaaaattattaaatcaaatattttttttcattttgttacagagatcaaactttttagtgaaaaactatcagaaaataaccaagaaaattttatttttaagacttgtaaacccaatatgacattttggtctatatctcaagaaacaaaaatttaaatcaaaaacaccgcactttttacattgcataacaccgttactaacaggtaaactagacaaggttaaactagggatgaatatgaaattactaagtaaatattttgtgagatcaatactgaacacgagcatatttggcatatacctagcaagttcgttttcttttgctgaacatcttgttgatttaaaagttgttggtgtaaccggtgtacaaaaaacgactaatgtagacgcttatataaataccattgatgaagaagagcgtgatggatctgaacgttatcaacaattagttcgaaccgcaattgataaagcattacgtgcttatggttattacagtagcacagtgaatttcactttacagccggcgaaatcatctaataaacccgtgcttgttgcaaatgtggacatgggaaggccaagtattattcaacgtgccgatgttactattcttggtgaagcaaaagatgatgaggtttttcaagatttacttcgtcgtactgcccaaaaaggcgaacacgtaagccatcctgtttatgaagactataaaagccggttgcaaaagcaattactcgctcgtgggtattttgatgcaaagtttgaggtttctcgttttgaaatcaaaccatccacttatcaaggttggtggaaaatggttttaaacagtggcactagatacaaattcggacaattcaattttaagcatagtcaaattcgtgaagattacttacgcaatatgatgccaatcaaaacaggcgataaatatttaattaatgatctctcatcacttaccaacgactatacatcatcaaattggtttagatcggttttattagaaccgaaagtcgatgaaaaacgcaaggtggttgatatcaatgtattgctttatcctcgcaagaaaaatgcaatagatgtagggattgggtattcgtctgatgtaggcactcgattcaagctcagttggattaagccttggattaataatcgtggacatagtttcaattccaatttatatatatcagccccaaaacaaactcttgaggcgaattataaaattcccttactgaaaaatccgcaaagatattattatgaactgtctggtggttttgaaaaggaaaatactaaagatactcaaactatagcagcaagttttgctgcattacgctactggaatagagtgaccggttggcaacattcttttgggttacgtgtacgttatgactcatttacccaagccaatgtttcagatagaacattatttatttatccaacaatatcagcgaatagaacacgcttaagaggtgagttatttcctacttggggagactcacaacgcatcacggtagattttggaagcaaacgttggaagtctgatgtaaacttctttcgaataaaggcctcaacagtttggatcagaacgtttaaagaaaatcatcgtttcttgacacgtggcgaaataggttggttacacaccaaagatattaataaaataccgcccgcacttcgcttttttgcaggcggggaacgtagtgtgcgtggatacggttacaagaaaatttctccaacatcttctgatggcaaaccaataggtgcaccatatctattaactgttaatactgagtaccaatatcaagtacttgaagattggtggctggcagcctttgctgatacggggttggctgctaataaatttaacgttaaagaactacgttatggtgccggttttggtgtgcgttgggtatcaccggtgggagcaataaaacttgatatagctacaccgattcgagatagagagaagaataaaaatatccaattttatattggattaggttcagaattataaggtcgtaaaaatgacacaaataccaaatgaaaatacaacaacagagcgacaggaaactcgctcggttaagccaaaacgtaaggtattacgcgggattttatgcacaataagtgcggtcattttattacttattttatttttagtaaccgcactggctacaaatagcggacaacgcttgttcattcagcttgctgatcatttcatagataatctgcatattgctcaaattgatggtgggttgcaagacggtttacaattaaaacaaattgcttttcacactcaaggtattaaagctgatattgaacaagcaaatataaaactggacttacattgtctattaagtggcaagatttgcttaaaaaatctcactttaaatcagcctaaaattcagattgatactgctcaactgccaaagtcggaaactaaaacgtcacaaccaatacaacaaatcaagctacctgttgaagtggacatcaatggtattgagatcaaccagctggatctcacaatagaccaacagcaagttaaattagcaaaatttcggaccgcacttactttaaacaatgagcaaggtttaactttactgcctacagaaattaatggtttaacgatagttcaccgacatctcacagaaaaaacagcgaagaagaaaaagagtgaaaaaactgtaagatcccctgttgattgggaaaaacttacacaacggttaaatcaaccgttattgcctgatatgcccgaaattgagctaccttttgatctacatattcaaggtattcaaggaaaaaattggctatatcaacaaattggcaattcaaatataccgcaaagtgatttacaccaaattgaaatatcaactatttatttacacgcagacagtatagataattctattcaattacaaacgtttcaacttgaaagtaatttaggtcagctacgaggtgaggggacattgcaactcaagcaagaatttccgatagaactacaagttcaagcaacgctcaatgaacttaaacatgatggaaaattgcttttgcctcacagtaacatcaatcttacattaagtggaaatcttaaaaaacaaaccgcacttttcctgcaaactcagggaacgtttgagtcgatattacagggtaaaattgagctttattcacaaaaaacaccgtttgacattgaattaaaagtaataaacggacaatatccatttgagaaaaactctacagaaccattgaaaattcaggacatgttttttactgcaaaaggagatttgctcaattatcaagccacattacaaggcaagctcattggtatgggaatgcctgaaaccgatgtggatttagcactacaaggcggattgacacaatttaccttacaacaacttcaagttaatgcgttaaatatgaaggcgaatgcaaacgccaatgtgagctggaaagataaacttaagttgaaaagcaatattgatctaaaaggacataatgttcggctaaataatatgcgaattaacaaaattgatttattggctaacattagtttacaagatatagtgcaaggacaagtcgatcttgatattgatggtttcagtttaaataatattaaattgaacagcactaaattacaaattaagggaacggaacaacaacactatttaatccttaaatcaaagggcgagccggcttccgcaaccttaaatttacaggggaaatttgaccgcactttacaacaatggcaaggtattttaagtcaagtgaatattcattctttaattggcaatttgaccaatagtgaaaatattttgttgtcttatgataataaaaagacaattgcacaagtttccgcccattgctggagatcatcggatattcatctctgttttccacaagagttcattgtaggaaaaaccggagaaattccgtttgattttaaaacaattaatttagcgttagtgaataaattgatctcacaagagattttcaaaggacatttatccggtcaaggaaaattcgcatggtttacggagagttctccttatttgacgctacaacttaaaggcgataatctcaatgtgacaaaaaaattagattatcgtacttttcgtttagctatcccaactttaaatataactacagagttacaaaacaataacttaaccctaaattctaattttaatattcaaaaccgaggagacgttaatatggaattaaaattagctgatttaaccaatcagaaaaggttaagtggtcatttaaaaattagcgatatgaatttaaatatagttaatcagttaatcgctagcagtgagaaagtagatggtcaagtcaatgcaaagttgagttttacaggtgatttaagtaatcctcttttgaatggtgaatttgctgtgagtcaagttcgagctaagttgaaatcagttccttttggtataacaaatggaaatattatactgagcttttatggtgatcgttcaattctaaaaggaaatattcaaactcacgaaagtcatttaaatgttgaaggtcaagcaaattggcgtaagatcgacgattggcaagcaggtttacatattaatgcagataaatttaaggtggatattccttccatagctaaattacaggtatcgccaaatattgaaattcatgcaacacctaaacgattagcgttaagtggtaatgttgatattccatgggcaaggatcgaaattgaacgtttacctgacaatatagttgctcccagtaaggatgaagtgattttagatggtccccaaaaaactaaagtagttaaattgatgaaaggagaaattgagacaactacaaagagcggtatacaaattcactctgacttaaaaatcaagctcggcgatcatgtgcgtttagaggcatatggtttgaaaaccgaattaaatggcttgctttcagtaaaacaagaaaaaggcaaccttggcttatttggacaaattaatttacacaatggtcattatgaatcttttggacaagatcttttaattcgtaaagggattattagcttttccggtttaccttctcaacctatgttaaatatagaagcaatacgaaatccgacatcaatggaaaatacgaatatgacagtaggtgcaaaaatagttggtattgccgatagtcctgaaatcactatattttccgagccaagtacctctcaagatcaagcactctcttatcttcttaccggacgatctttagaaaatagcggaaataatggttccggtggctcacttggtgcggcattattaggaatagggttagctaagagtggaaaattagtcggtggtattggtaaagtatttggtattcaaaatttgaacttggatacttctggtgttggcgacagttcaaaagttgtcgtaagcggtaatattacccctacattacagataaaatatggtattggtttattcgatggattggctgaattgaccctacgttatcgcctattacctaaactttatttacaatccgtttccggtataaaccaagcggtcgatctactttatcaatttgaattttaacgatgaataacgaaaatttattacaaaaagtaaccgcacttgtacaacaccgcggtgaagcgaaagaaattgccgctattgatttaggctccaatagctttcatatggtgattgcccgaattattaacggctctattcaagttttatctcgtttaaaacaaaaagtacaattggcggaagggttagatgaaaataatatgttaagccaagccgctatcaccagaggcgtaaactgtcttgctctttttgccgaacgcttacaaggatttgatcctcaaaatatcaatgtagtcggtacttatacattacgaagtgcggtcaataagatagaatttttacaacaggcggcagaggttttcccctatccgattaatatcattagtggggaaactgaggcaaaaacgatttattccggtgtttctcatacccaacctgagatcggtcggaaattcgtgattgatattggcggcggttcaacggaaatgattattggcgatgattttatccctttaattgccaatagtcgcaatatgggatgtgtcagttttgccaagaaattttttccatgtggcaaaatatcaagggataactttcaacgagctaaaaaaacggcaaaacaatgtattgaagatcttgccaagccttatcttgacttaaattgggattgtgttttaggttcttccggtaccatcaaaaccgttcatcaagttattagtaccaactataatcaacacgcaattatcacattatcgcacttaaacaagttgataacacaagtattgaaagctcaccatttcaataaattacatatcaatggactcaatgaagatcgtgtagatgtatttgttcccggacttgctattttgaccgcactttttgaaacctttgctatcaaagaaatgcgttattcagacggagcattgcgtgaggggattatttatagcttggaaaaggatttccaagtcaaaaatattcgccaacgtaccgcacttggtattatgcaacaatttaatgtggatctcgcacaagcggagcgaacctatcaaagcaccttattgctcagtgaacaatatcaaagttggcaagctgttgaattaaaaactgaaatgcaagatattctgttatgggcggcaaggttacatgaagtgggggtcgtgattaaccataaaaatttacaaaaacattccgcttacattctacaaaatatggaattgcccggatttgataaagaacagcaacgcttacttactacaataatccatcaccaatttaatcatttcaaaatgcctgacattggaaaatttgcacgctatccgagggctgatgtaatcgcacttgttcgtttattacgtttggctattttactcaataaatctcgccaagcgacatcgaaaacaaataacattaccctaaaaatcgaccgcactctaaaaaaatggtcattatattttgatgcagaatatcttgagcataaccctttagtcaaaaatgaattgatggaagaacaaaaacgcttgtcagaatttaacttagcactggacttttattcttaaaaaacgttatatagtagaacgtgcttgtttcatatcagttattgagtactacgataagatagactaatcaagcaatgaagacgggcagttttaacatgattagcgatgtgtttaagaatgcaagaaacagtgataaaaatttaaaaataatattattttacttggagagattatgcctaaactacgttcagcgaccagtacacaaggtcgtaatatggcaggtgcacgtgctttatggcgggcaacaggaatgaaagaaaatgatttcggtaaaccgattatcgcggttgtcaattcatttactcaatttgtacccggacatgttcacttaaaagatatggggcaactagttgctgctgaaattgaaaaatttggtggggtagcaaaagagtttaataccatcgctgtagatgatggaattgctatggggcatggaggtatgctctattctttaccgagccgagatttaattgccgatagtgttgaatatatggttaacgctcactgtgctgatgcgatggtttgtatttctaactgcgataagatcacaccaggaatgttaatggccgcattgcgtttgaatattccaacagtctttgtttcaggtggcccaatggaagcgggtaaaaccaaattatccgatcaaatcattaaattagacttagtggatgctatgattcaaggtgcaaatccgaatgtttcagatgatgtcagcgaacaaattgagcgttctgcttgtccaacttgtggctcttgttcaggtatgtttaccgccaattcaatgaattgtttaaccgaagcactgggcttgagcttaccgggaaatggctcatgtttggctactcatgccgaccgcaaacaacttttcttagcggcaggaaaacagattgttgaactgtgcaaacgttattatgaacaagatgatacatctgttttacctcgctcaattgccacaaaagaagcctttgataacgctatgagtcttgatatcgctatgggtggttcgaccaataccgttttgcatttattagctgctgcacaggaagcggaagtcaatttcactatggcggatattgatcgcctttctcgggtagtaccgtgcctgagcaaagttgcaccaaatacccaaaagtatcacatggaagatgtgcatcgtgctggcggtattatggcaattttaggtgaattagatcgtgccggcttgttgaatagccaaactcgtacaattttgggtatgagcataggcgaacaaattgcaaaatatgacatcaaactcactcaagataaagccatacataaatttttccgtgcaggaccggcagggattcgcactactcaagctttctcgcaagattgtcgttgggatacggttgatgatgatcgtgaaaatggttgtattcgcagtaaagaatttgcgtacagccaagatggtgggttagctatgttgtcaggcaatattgctttagacggttgtatagtcaaaactgctggagtagatgaaagcattttaaagttcagcggtaaagccattgtatttgaaagtcaagaagatgctgtatcaggcattttggggggtaaagtacaagctggacatgttgtggtgattcggtatgaaggaccaaaaggcggaccgggtatgcaagaaatgctttatccaaccagttatctcaaatctatgggcttaggtaaagcttgtgccttacttacagatggtcgtttctccggtggtacatcgggactgtctatcggacactgctcaccggaggcggcggcaggcggtttaattggtgtagtaaaagatggtgatattattgagattgatattccaaatcgtcgcatcgaattgatggtatccgaagaagaacttgctgagcgtcgagcagagcaagataaacttggctggaaaccagctaatcgccagagagaagtttcctttgctctaaaagtttacggatatttcgcaacatctgcggacaagggtgcagtacgagataaaacgaagatataaaagttaaaagtgcggtgttttttatctaatcgtgccctaaaaccacgtcctttagggggggatataaagcacaaatatgatatacttcttactgctaacagaggtcgctttagactctcaatgacggcataatcagggcaggacgtgcccgtagcgtctgtgaagtgaatcgcattggcggtcagcagcagaaacccaccgagagtagcccattgcttgcaatgggagctggtaggaatctccttgctttagctaggggaggacgtcaaagcagaaatggtagtgaaaatggcactttctgtaatagaaaaagttagtgatgattaataaaaataatcaaaaccaacttttgtctactgtgcttttttagatagcaggataaaatcacacctttttattaactattgaacttcaatactggcactttattttcggtgactgtttcttcttccactataactttctgtaagttttcaatagaagggagatcatacatagtatcaagcaatagggtttcaacaatagatcgcaaacctctggcacctgttttacgagctagtgcttttttcgccattgcaatcaatgcttcttgggtaaattctaattcaatattttctaagctgaataaaacttgatattgcttagttagggcatttttcggctcagttaaaatttttaccaaagcctcctcatccagttcgcttaaaggtgcgataacaggtaaacgaccgataaactccggtattaagccaaatttcattaaatcatcaggttcaacttgcttaaataattcggttaaactgactttctcttcatcaatacgaacatcagcaccaaaaccaatacctttgccaccggtattcgttcttttctcaataattttatctaaaccggcaaaagcaccgccacaaataaataaaatcttagaggtgtccacacgcaacatttcttgttgaggatgctttcgtccgccttgtggaggaatagaagctaccgttccttcaactaattttagtaaagcctgctgcacaccttcgcctgatacatcacgagtaatagaaggattttcagacttacgtgtaatcttatcaatttcatcaatatagataataccttgttgagctttctctatatcataatcacaattttgtaataatttttgcaagacattttcaacatcttcaccaacatatcccgcttcagttaaagttgttgcatctgccattgcaaagggaacattgagcatacgagctaacgtttgtgccaataaagtcttgccactgcctgtcgggccgataagcaaaatattacttttgcccaattcaacctcagaagtatttttttcgctacgtaaacgtttataatgattatacaccgccacagctaatacttttttagcataatcttggcctatgacataatcatctaaatgtgcacgaatttcatgtggtgtcggtaatttaggctcttcctcttgaaattcttcatcaatttcttcgatgtcatccgcattagctaacatgtcatgacataattcaatacactcattacaaatataaccggatgtgcctgcaattaatttatctacttctttttgttccttaccacaaaaagagcaatgtaattctttttcttttgtcatttctttacccaatatctaccgtttaattaacacgtcatcaactaaaccgtacaattttgcctgttctgcagacataaaattatcacgatcagtatcttgttcaatttgttcaatagattgtcctgtatgaaatgctaaacgttcatttaacgtttgcttaatttttaaaatttcttgtgcatgaatttgaatatcagaggcttgtcctctaaagccacctaaaggctgatgaatcatcactcttgcatgaggcaatgccgcccttttacctgctgtgccacccgccaataaaaatgctcccattgaacatgcttgtccaatacaaagagttctcacatcaggcttaataaattgcatagtatcataaattgccattccggcagtgactgaaccgccgggagagtttatataaatattaatgtcttttgctggatcttccgcttccaaaaagagaagttgagcaacaatcaagtttgccatacgatcttcaacttctccagtcagaaaaatcacccgctcttttaatagacgtgaataaatatcataagatcgttcgcctcttgatgtttgttctacgaccataggaatgacgctcatatatacctcttctaaaaaatctaaataacaaaagtgcggtcattcttacaaaacgaccgcacttaaaactataaaaagctataaattacgcttgagggttcattacttcatcaaacgaagacgctttctcagttacctgtgctttcgttaatacagcatcaacagcttgttgttctaacacgacattgcgaatgttattcattaactctttgtttttactataatattcaatcacttctgctggttgttcataagctgatgcaatatctgcgatcatcgctttaacacgttcttcatcagcctttaactcattagaagagatgacttcagagaataataaaccaacctgaacacggcgtttagcttgttcttcgaataattcacgtggtaattgtgcagcttgttgagcattaccgccaaaacgttgtgctgcttgattacgtaatacttcaatttcttgctcaactgcggcagtaggtacttcaattggattttgctctaacaaaccgtcaattacctgagttttaatacgagaaaccaaagcatttttcaattcacgttgcatattttttgcaatttcattgcgtaaatccgctacattttttgtattagggccaaattttgccacaaattcatctgttaattcaggtaattgcattacttctacttttttcaaagtaatcgaaaatttagcagctttcccttttagattttcagcatgataagtttcagggaaggttacattaatttcaaattgttcacccgctttatgaccaatgataccctcttcaaaaccgggaatcatccgaccttgccccattgctaaaacaaagtctgttgattttccaccctcaaactcttcgccatcaacagagccaacgaaatcgatagtaacacgatcatcagctttagcaacatcttgagtttcaatccaagttgcttgttgtttacgtaaaatgtcaagcatcttatcaatatcggcgtctgaaatttccacaaccggtttttcaaccttgattttatccagtccttgaagctgaatctctggataaacctcaaaagtcgctgtaaattttaattctttaccagcttcaaattgttctactgtaaattctgggcgaccggctaaattcactttattttcaagcatcacattgaaaaaatgtttttgtaataaatcgcctaatacatcttggcgaacagatgcaccaaaacgtttttcaatcatttgtgccggtactttacctttacggaaaccgtcaatacgtgcattttttgctacacgtttcaattcttcacgcacagcttgctcaacagcttcagaaggaacggtgatatttacacgacgctcaagaccttgagttgtttcaatattaaatgacattatgttacctcaaaaagaatttgtactcggcggaaacacgcaccgaacacgttagtaaattaaatttacattaaaagacgaggaattatagcgatacaaaagcaaacagtcgaggaaatgacaaataaaaatctgcatttgaacattttttagcctaatagataaaatttttttgccaagaagtttttccataattttggttctcctgttgagaaatataaaatttctgatgttcgcatatcacaaaaagttatttttacgatccagatcgtaaaaaaagtgcgatggtattttccatattttctttttgcaacaaaattctcagtacatcattaaccgaataatataaacgcacaatatgataattcctcaatctgaagatatgtctccgatagtgatgtcgatcgatggagatacttatgaaataacaccgcatttatggcaaagaaatcagcaacaatcccaaattctgctacgctattttgccattcctttacaggaaaatgaacaaacgttatggttaggcgttgatagtctaaataatattagtgcctgtgaaacatttgcatttttgtatggaaaaattgtagaaccggttttacttaataaccaattacttaaacagttactacaaaacttatcaccacagcaaaataatatgttcgttgaagagcaacctataaatcaatatgtagccgagcatcgtatagaagtaactgaaaagtctgatgaacccgtgattcaacttttagatcacatttttgaaaatgcgttaaagcaaaatgtatcagatattcatattgaaccacaaatgaattgcttgcaaatacgtttcagaatagacggtattttacaatgccaatcgcctcttccgttttcgctgagtaagcgtattctttcacgtttaaagttactggccaaattggatataagcgaaacacggttacctcaagatggacgatttcattttaaaacaacattttctgacatccttgattttcgtttatcaacccttccgacgaatatgggtgaaaaagccgtgttgcgtttacagcaaaataaacctgtacagttgagttttgcggaactcggtatgacagaaaaccagcaaaaatcattcaaacaggcactatctcaaccccaaggactcattttagtgacaggcccaacagggagtggaaaaagtatctcactttacactgcacttcaatggctgaatgataagcacaaacatattatgacagcggaagatccgatagaaattgaattgaacggtatcattcaatgtcaaataaatccgcagatcgggttagattttagccgactgttaagaacttttcttcgtcaagatcctgacattattatgttgggtgaaattcgggataacgaaagtgcaataatggcattaagagcagcacaaaccggacatcttgttctctcaactttacatacaaatgatgctccgtcggcagtctcacgcttgcttcaattgggggtaaagcaacatgaaattgacaatagtttattattggtcatcgctcaacgcttggtacgaaaaaaatgtccacatacagaaaatgaaaattgcacttgtcatcagaaatatcaagggcgaattggtgtttatcaatttttacaaccgcatctaatagataatcatatttgctaccaaacggattatgctcatttgcgtgaaagtgcaatggaaaaagtgcggttagaaataacagatttagcagaagtggatagagttattggacaaagtagtgaataaaaaacggatcttcatgatccgcttttaacctatttaaactttttcaactttaacttgtttaatcatattatccgccacttctaatacagtaatttttagcccatttatttcacattcagttccttcattaggaatttcttctaaatgttctaaaatcaatccattaaaagtgcgggcatcttcggtatctaaattccaattaaataatttatttaaatcacgtaaattggcagatccttcaataattattgttccgtcagattgctgtgtcacttcttcatcaatagatggggcggttgaagtggtaaattcaccgacaatttcttccaaaatatcttctaacgttacgagtcctttaatatccccatattcgtctacgaccaagccaatacgttctttattgttgcggaaattaagtaattgagtatttaattctgtcccctcagggataaaataagtttcatctactgcacgaatgagcgtttctttactaaattcatttttatccagcattaggcgataagcctcacgaacccgtaatatacccagtacattttcatcaatactgcctttataaagtacaacacgcccgtgagcggcatgattcagctgacgcataatcgctttccaatcatcatcaacatcaataccggctatatcattacgtggcaccataatgtcatcgaccgtaactttctctaagtccaaaatagaaagaagcatttcttggtgtgcagaagggatatattgtcctgattgattcactattgcacgtaattcttctgagttaagagaatgtgcttttacttcattttttaaacgaaaaagtttcattagcccgctaataaatagatttataataaaaactaatggactaaaaattttcaatagtatgctaataatatgacttgaaacaaaagcaactttttcaggataaagtgcggcaatagttttaggaaaaatttctgaaaaaattaacattacaaaggtcaataaacctgtcgcaacggcaacgccaacatcaccatatatacgcatacctataatggttgcaattgctgatgcggaaatattaactaagttattgcaaattaaaattagactgaggaaaacatccgttctcttaagcaatttctctgttttttgtgcccctttatgccctttttctgctaaaaatcgcatacgatagcgattaacggaaagcactcccgtttcagaaccggaaaaataagctgagagaataagtaagataattaatgtaataaataaggtactaagggggatactatccaaaatataatcctttcattcatttccataatgccataatatttttacttatgacaatgagaccaagacattttataactctaaaataacacgactaccgaaataagcgacagtgagcaagatcatacctgaaattgtataaataatcattctttttcctcgccaatataatttccaatgtccaaataaagctataccgaaaacaaaccaagctaaaaacgaaaaaatagctttgggaatattatgagcggagaaaaaatcaattaattgaatgctaccggaaataagtgtcaaagtaagtaatatttgcccgctaaacaaagagcgaaagaaatgtttttcaacggtcattaatggaggaacagccggtgagaaagttaattttttactttttaagctattatcaatccagcgtaattgaatggcatacaacatagcaataaaacaaacggaatatgcaaataaagataaggcaatatggaataataaacttgtattttgacttaaatgataaacccaaatttcaggtaataatgcttgtaaaattaaattgataatagaaaaacagtaaactataggcaacagaaaccaaagtgtttttactcgagccaaaatggcaacagttgcaatagcagcaatcatggcactcactaacgagcaaatttcaattaacgtgaaattattacctatgaacaaatgaataaataacttatttaacgcaataaaatggctaataattgcgatgagtgcggtgactaaaaaagccattttattcaacttaacttcttgaccgccttgccctaataacattggcatgattaataaaatgctaattaaataaaaaaaagctgaaataaccgcaaaccacataaatttaccttacacaatatataataatggttcttattctaacttatccacttgataaaatcgctataaatttcttgcaaatgatgaaaatttaccgaatttcagtataattaaagcggtagttttttcaagaaaatataggattagaaatgtttgaaaatttatcggatcgcttgtcaaaaaccttgcgtaatattaccggaaaaggtcgtttaactgaagataatattaaagatacattgcgtgaagtcagaatggcgttattagaggctgacgttgccttacctgttgtccgtgaatttattcatcaagtcaaggaacgagcgattggcgaagaagtcaataaaagtcttacgcctggacaagaatttctcaaaattgtccaaaccgaattagaaaaagccatgggggtggcaaatgaaaaactcaatttagccactcaaccaccagctgtgattttaatggcaggtttacaaggtgcaggaaaaacaacctccgtcggtaaattggcgaaattcctaaaagagaactacaaaaagaaaataatggtagtttctgtcgacgtctatcgtccagcagcaattaaacagttggaaacattggctcaatctatcggcgttgatttttatccttccgatgtttcacaaaaacctgttgaaattgcacgtactgcattggctgaggcaaaactaaaattctatgatgtcctaattgttgatactgccggtcgtttgcatgtagatgacacaatgatggaagaaattcaacaaattcataccgcacttaatccaattgagaccctatttactgtcgatgctatgacaggtcaagatgcagcgaatacagcaaaagcatttaatgaggcattaccactgacggggatcattttaacgaaagttgacggtgatgctcgtggtggtgcggcactttctattcgtcatattaccggaaaaccaattaaattcttaggtgtcggtgaaaaaaccgatgctcttgaaccgttccatccggatcgtattgcttctcgtattttaggcatgggtgatgttctttctttgattgaagatttacaacgttcagtcgatcaagaaaaagcagaaaaaatggcaaaaaaattcaagaaaggagatagctttactcttgaagattttcgtgaacaacttatcgaaatgaaaaaaatgggcggaatgatgtccatgctggaaaaactgccgggtgccagaaatctccctgatcatgtgaaaaatcaagtggatgataaaatgttcaataaaatggaggcaattattaactccatgaccttaaaagagcggtccaatccagatattatcaaaggttcacgccgacgccggattgcattgggttcaggtacgcaagtgcaagatgtgaataatctgttgagacagttcaatgaaatgcagcgtatgatgaaaaaaatgcgaaaaggcggtatggcgagaatgatgcgtggcatgcaaggcatgatggggggattaggtggattaggaaatatgtttagacgttaatatccacatatttatagggcgagttggatactcgcctttcttttattcagtttttgttaaatctctaatcttgcgatagaccacgtccaaattcgtactaaaatgaattttatgtatttctttcactgtcttagatttaacaatcgttcttaagggttggaactgcatattgcacatatgcaattcttgtgaaggcaacatatgttggataaaacgggtcaaagcatgaattcctccagcatcaagcacagtcactgcatcacattgcaatacaatatgtttgatctctttccctgtatgagtagttttttcatgtaagtcggcaaacaagttatccgctgcggcaaaaaagagcggtccgctaatacgaaaaactacggtatcacacagatcctcaggatgtgcaatttcaaaagatcttgtcatttcagcaatagtacggataaacaatagacttgctaaaagcacgccaacggtaattgcaattaccatgtcaaaaatgacagttaaagttaaacaagtcagcaagactgcaatttcattcaaacctgatcgacggattaattgaacaatttgcccaacgtttgccatattccaagcaaccacaagcaacaacgcagacatagaggcaagcggtaaataagacaatgcttttgcaaaaaataatagagagaataaaactaataaagcatgtatcacactggaaataggtgacaccgcccctgatttcacattagccgcagaacgagcaatagctgctgttgctgtaatccctcctaaaaatggtgcaacgatatttcctaacccttgagccaataattcattattagaatggtgcttagtactagtcatattatccaatatcaccgcacaaagtagagattcaattgcacctaatactgccatagaaaatgccgccggcaataaggcctgcaaagtattgaaatcccaattgatcacttctccatcagcattgggaaaattccaaggcaaaataatttcgggtatgacattcggaataccatatcccgtactaccgtctgataggctataactaaaagaagagcctattgttgccacatcaaagccaaaatgaatcaatgcaatggataataacgtaccgataataacagcgggcaggtgaccgggtataggtaaacgaaacttatgccattttgtcagtaaaattagcgttacagttccgactgcagtatcagcccaattaattgttggaagtgcggtaaaaattgcttgcaatttgccaaggtaatgtaccggcatggtggcgacatttaagccaagaaaatctttaatttgcaatgtcgcaataacaatcccaattccacaagtaaaaccaagcgttacagagagcggaatatattcaatcaaacgacctagacgaaaaaaagccattaaaattaaaataatccctgacaatagagttgccatgagtaacccgcttaacccaaattgctgcgtcacagggtataaaatcaccacaaatgccgctgtagggccggaaatattaaaacgagagccaccggacagagcaatcactatcccagcaacaatagcggtatataagccgtgctgaggcggtacaccgctggcaatagctaatgccatggacaaaggaatagcaataacaccaacagtaagtcctgcaataatgtcctttataagatgcgacttaccatagccaattttaaagctatcttgcagtgcactaaaaggacgaacagcaagaaaaatatttttagttaaaaaccacttcttcaacatataaattccaacagacaagatgatagagagaagtattgtaactgaaatttaagctaataatttgttttagcacaagaaaaataaaaaatacttgactgaattagaagaaatctttatatttgccgccctaacttcaatggtgagatgtccgagtggttgaaggagcacgcctggaaagcgtgtatgtgggaaactgcatcgggggttcgaatccccctctcaccgccagagctcttcttttctctgtttttttctgtcttttttctttcattttttatcattaattcattgaaatataagcattttttgcgttttttctgtgtttttctgtgttttctctgtttttttgttatctgtgtttatgtgcctttttgttactaaatgatccctaatttgtgagcttttactcacaaaattttaattttggattttttagggatcatttgggatcttttgggcttgtttattcaattaaatcatgaggttagatgatggctaaaattaatcaatcttttgtcgataaactgaaaactacggggaaacaagagcagatttctttgggatataagctttttttggttatgtctcctaaggggactaaatcttatcgttatatttttcggcatcctgttactaaggctattaagaagaagaatttgggaaatgctgatgtgatgtctcttgagtccgctttgtctttggctatttcttttaattctttgcttgagcaaggtgtcgatcctgttgagaattttaaggcacaatttaagcctgtggagagggttgtttttactctgtctatggttgttgaggattggcatgttactaaggggatgcgtttgagcgagaaacatttacgcgataggttagcccgttttaagcgttatttgttgcctcactttggggagcgggaggttttggatatttctttgtttgaggctcgggaggttattaaggctatttttgagcgtgcacctcatatgggggagaaggtggcccgtgatttgcgggagttgggcgatcatgctgttgatatgggggtttggagtgctaatcttttggctcctattaagcgttcttttcctcggcctaaggctgttaataatccttgtattcgtgccgatgagttgccggaatttttgtgtgtgttggctcgctctcgtttggattttcagactcggcttttgattgaatttcagcttttgactatggttcgggctaatgaggttgttactgccaggtgggttgatgtggattttgttaatgcggtttggcgtattcccgctgagaatatgaagatgaataaggcccatgatgtgccgttgagctctcaggctgttgctctgttgttggagttgcgtaagtttaatgctgataagccttttgttttccctcatcgctctattgacatcctcccccgcctaaaggcaggggattcctactagctcccacagcaagctgtgggctactctcggtgggtttctactgctgatctctattgagattcacttcatagacgcttcgggtatgtcctaccctgatatttattatgcttggactattgcttgcccacgtgtgagaacattcattgctcccactacatcggcattttctgtatagccacattctacacattcaaaatgagcttgagtttcacggttttcttttgcaatatgcccacaacaagggcaagttcgactagtattctgtgctggaacagcaactaaaaatccgccaagccattgcgttttatagtctagctgtcgtctaaattcaaaccaagattgatcccgtattgaacggtttaarcctgatttctgyttcacatttttkccgtgtgcttccactgtgccttttgccgatttggacatattcgcaacttgcaaatcttcaacgtagatcattgcgtggtttttgctgatttgrgttgagattttgtgcaaaaaatcttttcggcagttagctattttatggtgtaatttgccgattttttctttcagtttttgccggtttttactgaacttcactttatttttragcygtttttgcagtttkgcyaacttacctttrtaggttttraacgcatttatcggctcaaaaaattcgccattagacagggtcgcaaagcgtgcaatrcccatatcaatgccaatctctccgcctttatgygtcggtctttcctgttcaaattccgtttgaatrctcacaaaaaagcgaccgcacttttggctgacggtgacatttttcacttcgcccacaatttcacgactattacgatagcgaacccaaccgattttcggcagatacaagcggtcgttttgtggctgaattttgcagccttgcggaaaacgaaagctctcttttatgccttttttcttgaattttgggaagtctgcacgctgctgaaagaaatttttgaacgcactttcaagatcttttaacgactgttgcaacacttgagaatggcattctttgagccaaattagctcttttttccattgcggaagtagattagcgatgttggaatagcggaatttatgattattatccagttcgtattgttcattttgccacgctaatgccttattgaacacaaaacgggaacaaccgcaaaactgcttgattttacggatttgttcrccatkcggtctratytcaaatttaaacgctttacgaattaacattgctcaaactagaatacaaagattrtkmttattmtactcttggtctatgaaaaaagaaacagaaattagacgtggtcgccacgttgtctttaacttacacgttcatttggtattcgtgactaaatatcgcggggaagtttttactcaacttattttgaacgacttaaaagcgatttttgaatccgtctgttcggattttgaagcaaaattagtagaatttgatggcgaagacgatcacgttcatttacttgttgaatatccaccgaaagtggctatatcaaaccttgtgaacagtttaaaaggcgtttcaagcagaatgattagaaagaaaaactatccgagtattcgcaaaaaattatggggaaatcagctttggtctccgtcttattttgcaggaagttgcggtggtgcacccatatctattattcgccaatacattgagcaacaacaaacacctgaktagttaggtttgaaacggctacgccgtttgtgccttatatccacgccctaaaggacgtggttttacggcactgtctgataaaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttggcgtgcctgttgttctgaattagcacgtatagccagttttagacggttttcgcctaagaataggataaatttgaatagcattttgattgtctctttgtttagtaaatgtgaattgctgttccctaaagggtgtagcaaggtttcaactaccgcaaagaaacggctagcgttattcgtgcggataaactccgccttatttccgcttatcaaccttgccacaaattcagataaacagattgagcttagtaggctcaagccattgatcataggaatttgaggtaaaaaaattccgcaagtcttacgggtgcggtagccgttctttgtagtagtgtcgccaatactaaccgcactttgattttttagcaatactgaaaatttgatttttgtcatgtttctgtaccttttcaaactcatttaggctataatccatgacgttctttttagaactccatgatttatttctttcctatgagttaagttaatttacttgtgcccttgccatttggttgagggcttttttgttgggttatttccactaaactgggtgtaatcttggtgttgtcccttagggttcttctatcgtttttgctatcatctccaatcgcttacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcttaaagtgcggtattgttttgggttaattcgagcgtagcaaattgcattactgaggtttacgcggttgcgggcttgttgctcgttgttggcgaaaatactgaggtgtaggcggtttttgcctagtaaaatgaatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnataaaacaaaattcataataatttccttggtatttctccttgtttgccccggttatgcactacgccggggctttttttatttgctgtttttgccatgcgatcaggttttctctatcccaaatgggaatgttgcccattttttgcggtttggggattattccctgttggcaatatttgtagagcgttgaacggcttatgttgagaaattgacaaacttctcgggttcgcatgtagcagctgacttgtattacgggttcttgcatagtcctccttgttggttggtttttcctgtcttttctgtttttctgttttctgttcgtggctatgttagccgtttaagtaggtttgggttggcaaatttgccaagatactttttttgattggcgttaggcttggttgtaccagttctcaagggttacatcggaggggattgccatattgagatttgccagtatatcgccatgttgatttcttaggcgttcgaggtcttgcccgagcttgccattgcgtaaggcgttgcgggcttgttgtggggttttaatatcgtaatggagatataatagggttttgatgaaattaatttgatgttgtgcaatgcgggggcttggcggtttgccatttgcccctgcgatgcggttagttctgttttttttgttggtatagctcaatgagcattttaagcacttccggacggcttttgccttgttctttggcgattacatcgaattggtccgccagttcgctattgataagcatgctaatttggcgtagtttgccttcagcttttaggcgttgattgcgttcttttgcggtttgtgctctgagctttttactatgttctgtgtttgaatttgccatggttttctcctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaagccggggcgttcttgtttctagcccttgccagatgttttatattatatagacttatataataaaagcaagtatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatttgttggcttatttgttctatctcttctatcacttctagcgggagtttaaaggctttaagtttaatccctcgctttgcatcagattttgcaactcgttcagcgtttgtggttgccatggttttctcctgtctttacttgatttttaaaagttgaagttgtatagtttaggaactgcctagcggtcgcacccgctaggacttacgtcatcctaataagctgattggcttattactaataggatgattagaatgatgattaaccatggattcatcttctatttcctaagttgccccggtttctccaagccggggtttcttgtttctagccccttgccagatgggtttatattatatagacttatataataaaagcaagtatttcttgaaaaaataccgcactttttgggtgcggtttttttctatttgttggcttgtttaaaacattctagtgcttggataataagttggttttgcggtatgcccatttgttggcttatttgttctatctcttctatcacttctagcgggagtttaaaggctttaagtttaatccctcgctttgcatcagattttgcaactcgttcagcgtttgtggttgccatgtttttctccttgatttttttaagtgggttgtttaagattggagctgttagggaggaggcaccctccctaacatttgttatcttaattagtaagcgttatggcttatgcttattaagacaactaggatgatgattttgattagcatatcctagctccatttaatgccccgtaactgaacaagtcggggcgttcttgtttctagccccttgctagatgtcctcattatattagataactaatattaatacaagtatttcttgaaaaaataccacactttttgggtgcggtttttttctatttgttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatttatacaagtatttcttgaaaaaataccacactttttgggtgcggtttttttgttatttattgctctctctatacatttcacaaagttttttaattgcttgcggtcttgatagacctagttcttgtgcaatagcatctaattcgtttgcatcttcggtggcaaattgcatagtgatacgtttgacaataccagcctctaggcgctttttattccattcattcgctgtttttattcttaatttgcgtgaatgttctgtttttgcgtatgccattgttttctccttacttgattttgttagtcggtggttgtatattaggaactgcctagcggtggcacccgctaggacttacgttatccttagtaagcgggtaaacttactaagataaagataactaggattaatactttaaccaacataatccagttcctattttagttgagcggtgaaagccgctcttcttatttccgccctattgcgaaaacgtgattagtatattgcaataatatactaatcacaagcattatcttttttattttctttgtttttcttctcttttttcttcttctcttttttcttcttctcttttttctcctcaattcctaaaaaataggaacaaaattcctaaaaaataggaacaaaataggaaaaaataggaacactaaattttattaagtttttgatttttaaaatattcattttaaaaattcctatttttcctaattttcctaatttaatttcatgtataaatgtttttataataaaaaagcacccctaagggtgcttatttatttacatccacatagtggaattggcattggtcgatgttttgctctgataattgctccagtttttggatcttcacgagtccatctgaaaataatagggcaaacacagccacatttagaacaaatagtcgtagccataagactaatctccatttgataagttgccatcacttatctatggacaataccgtacaatctgttttagaatagactaccgtttcttctatgttgtaggtattgtgtacagcggatggagaactgcacatagtaattaatacgccaatattaattatttccagtaaagacccagccatttcagttgggttttttacattacgcaaaaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaatttatgaaatgcggatagataccggcaaggggtatagaatttattacgcaaaaattgaggatattatctatttgctaacaaacggtggagataaaaaaactcagcaacaggatataagcgatgcccaagtgatattagaaaaatttaaacaattaggagatgatgaaaatgagtgaacaaaacaatatagaagtgactgattttgatgctgcagaatttttagaaaatgatgagttgatcgctttatatcttgcggagacattaaagaatggcaatgatgaagaatttattcaagcactcaatactgtggctagagcaaaaggcatgaatgatattgcgaaaaaagcggggattgctcgtgaaagcctttatcaaactctttcaagcaataagccgagatttgaaactgtgcgtaaaatcttaaatgctttaaatattgatctcattcctacggtaaaaacggcttaaatgccgtttttttctgtgccattcctattttttaggataaaaataggaacaaaattcctaaaaaataggaacaaaataggaaaaaataggaacactcaattttattaaagtattgatttttaacatattcattttaaaaattcctatttttcctatttttcctaatttaatttcatatataaatatttttataaataaaatttgtattattgccgttttctatgaaaatttttcacttttttattcttcttatctgatcaaatatttacgcataacaaaaaagcagaataccaaatgatccctaaaagatagttttaaaaacaagaacccttattgtataaggcttgaaccctcgaagcagatgaaccctctcaccgccatctaactgtaaaataaagtttgtcttgtaaaaaacaattaaaaaatcaataagttaccattccttaattgttcacattgtaaaataatgtttgtcattgtaatcgcttgatgttcccttttatgttccttttttgagagctaaaaaagtaacagcaacgttatttttatgtagagctaaaatctatgtaaacgtttgcttaatgaaagcgggctgcggtaaaataacccgattttatttaaagctaataaggtattcatatgacacagctaagtttgaaaaaaatttattcggggaaagtacgggatctctatgaaattgatgataaacgcatgttaatggttgcaacggatcgtttgtcggcattcgatgtaattttagatgatcctattgatcgtaaaggtgaaattttgacgcagatttctaatttttggttcaagaaattagcccatattatgccaaatcattttaccggtgaaactgtttacgatgttttacctcaagccgaggcagatttggttaaagatcgtgctgttgtttgcaaacgccttactcccatcaaaattgagagtatcgtacgaggctatttaacaggatcgggattgaaagattataaagccactggcacaatctgcggattaaaattgccgggaggtttggttgaggcaagtaaattacctgagccgatttttacaccttcaagtaaagcaaaagtaggtgatcatgatataaacattagctatgcggaatgtgagcaattaattggtgttgagcttgcaaagcaagtacgggaaaaagcgatttcactttataaagaggcagcggaatatgcactgactaaaggtatcattatttgtgatacgaagtttgaatttggtttagatgaaaatggcgtattaaccttaatggacgaagttttaacgccggattcaagtcgtttctggtctgtggaaacttatcaagaaggcactaatccgccgtctttcgacaaacaattcgtgcgtgattggctggaaaagagtggttggaataaacaggctcctgcacctaaagtccccgctgatgttatccaaaaaactgttgataaatataaagaggtattggatttattaacaaaataattggaagtgcggtgaaaatttgttaaatttgaccgcacttttgccatgaaataagtttgagataatatgagagctgtttcaatcgtagggttagggtggttaggtttaacacttgcccgtcatttaaaaaatttgggttggaaagttaaaggcaccaaacgcacacatgaaggcgtggagcaaatgcgtttaattcgattggaagcctatcatctggaactcacacccgatattaatgctgatcccgatgatctaacagcattactttctgtggatgctttagttatcaatattccaccgagtcaatatttttttcatttacaacactacgtacagggcgttaaaaacttagtgaatgaggcattgttaaacggtcttcaacatattatttttatcagctcaacctctgtatttcctgatgtttcaggcgaatttgatgaacaaagtcagattgtaccccagtcagaaatgagtaaagcattgcttgaaattgagcaatggctgtttgagctgaaagatgttgactgcgatattattcgttttgggggacttgtgggcgaggatcgtcatcctgtttattctttagcgggaaaagatgaattatcagcggggaatatgccgatcaatttggtgcatgttgatgattgtgcaagagctattcaattgttattggaaacaccaagttcccagcgtttatatcatttggtcgcaccgcaacatccgactcgagcagaatattactcacagatagcagaaaaattatcactggaagcaccgcactttatttgttcggaacaagatccaagacgtgttattttagcgaataaaatttgccgagagctcagttttgtttatcagtgtccagatccttatttgatgttatttgaaagaaaataaaaaatatccgatttgcatttttaatcaaaaaaatgcaataatatgcagaatttattcaaaaaaaaatctataatgcaaaaaagaaggtcataaatgtcaaatacaattttacaacatcttccaattggtcaaaaagtaggcattgctttttccggtggtttggataccagtgcagcattactttggatgcgtcaaaaaggcgctgtaccttatgcttataccgccaatttaggtcaacctgacgaagaagattataatgctattcctcgtaaagcaatggaatatggtgcagaaaaagctcgtttaattgattgccgcaatcagcttgctcatgaaggtattgccgctattcaatgcggagcctttcatatttccacaggcggtgtaacgtattttaatactacgcctttaggtcgtgcggtaacaggtaccatgcttgtttcagctatgaaagaagatgatgttaatatttggggcgatggttccactttcaaaggcaatgatattgagcgtttttatcgctacgggttattaactaatccgagtttacgtatttataaaccttggttggataatcaatttattgatgagctgggtggccgtcaagaaatgtccgagtttttaatcgcaaacgggtttgattacaaaatgtctgttgaaaaagcttactcgacggattccaatatgttaggtgctactcatgaagcaaaagatttagaatatctcaatagcggtattcgtattgttaagcctattatgggtgttgccttttggcgtgatgatgtaactgtgaaagcggaagaagtgacggtcggatttgaagacggtgttcctgtcacattaaacggtcagtctttttcaagtgcggtcgaactctttttagaagccaatcgcatcggcggtcgtcatggtctgggaatgtccgatcaaattgaaaatcgtatcattgaagcgaaaagtcgtggcatctacgaagctccgggtatggcgttattgcatatcgcctatgagcgtttggttacggcgatccataatgaagatactattgaacaatatcgtatcaatgggttgcgtttagggcgtttattataccaaggacgttggtttgatccgcaagcattgatgttacgtgaaacagctcaacgttgggtagcccgtgcggtaaccggtgaagttacattagaattacgccgtggtaacgattattctattttaaatacagtgtcaccgaatatgacttatcatcctgaacgtttaagtatggaaaaagtggaaaatgcaccgtttgatccgtccgatcgtataggtcaacttaccatgcgtaatcttgatattacggatacgcgtgataaattgggtatttatacacataccggattactgactgtaggtaaagattcaatgttaccacaattggataaaaaatagtttttttacacgccgacatagttgaccgcacttttaagtgcggttagtttttgctacaattccccgttttaaaacaagcaggttatacaaacgacggattcatctgataatgaaaaatttattttcttttccttctttctatcagttttctaatgaaagacgttttttaaaacggttaagaactcgtattcgctattatttttatcgtttaacttgttttaaagaatgtcagatttttgttacctatttaaatcataatcctctttggattgatatattcacgaaaagttacaatcgttgtgatgctgtgcttagaaagtattgcgataaccgttttaataaaaaacaacgtgtacaagcaattatggataatttttccgtagcagaacaagtatttgggcggtctttctcacaactgttagttgaaaaagataaggttttattggctgaattaacagatgagttggatttgtatttagcaattaatcaaatagatccttttgaggggttttttgcggtaaatattcgcaataaacagggtcaacgtatttacgatgcctctttttcttttttggcagggaataaattattgatcacgtctgtgcaaggacctagtgatgataattcacaagaattaattaaatcgacaacgaagcaattacatggtgtacgcccaatgtttatgttggtaaatgtgtataaattgttagcaaaagagctgaattatgaacttttaggcatagcacataaaaatcaaggaaaatatcgttggaacgacaatgcacgtttgttatttaattatgatgatttttggcaagaaaataatgcacttttaaaccctcagggctattggcaattacctgtagttattgaacgtaagacgctggaagatattcaaagtaaaaagcgttccatgtatcgcaagcgttatgaaatgtttgattttattgaaaaaaatataactgagatttttggaaaagaaaatttgaataaatagaccgctctatttggtattcaagttttaaatggcatataatgagttgctattgatttttagtttgttttattaatttaaaggtatgactgtgacaactgaacgtattgcaagaataattgaatcaaaagaaattatgacacttctccctcatcgctatccgtttttattggtagatcgtgtaactgattatgaagaagggaaatggttaaccgcaattaaaaatgtgagtgtaaatgaaccttgttttacaggtcatttccctgaccaacctattttgccgggggtattaattttagaagcattagcacaagcaatggggattttggcgttcaaaactcacgagttaagtaataaagagctattttattttgccggtgtggatgaggcacgttttaaacgtcctattttaccgggagatcaaatgatgttaaaagttgaagtcattagggaacgccgtggtattaccgcttttacaggtgtggcgagtgtaaatggtgaagtagcttgtgaagccaaattaatgtgtgctcgtagataattaaggagcaaaaatgattcattcgactgcaaaaatccatccttcttctattatcgaagaaggtgcaaaaattggtgaaaatgttgttattggtcctttttgtattgtgggaagcgatgtacaaattggtaaaggtaccacgttatattcccatgttgtcgtgaagggagtaactaccataggggaagataaccaaattttccaatttgccagcattggtgaagtcaatcaagatcttaaatatcaaggtgaaccaacgaaaacgattattggtcatcgtaatcgtattcgtgaaagtgtgactattcatcgtgggacagtgcaaggtggtggtgtaactcgtattggtgatgacaacttgttgatgattaatgctcatattgcacatgattgtcaaattggaaatcgttgcattttagccaataatgcgacgttagcaggacatgttgaattaggtgattttgttattgttggcggtatgtcagccattcatcaatttgttattgttggtgcacatgtaatgctaggtggtggttctatggtaagtcaagatgtgccgccttatgtaatggcacaaggcaatcatgcacggcctttcggagtaaatatagaggggctaaaacgccgtggttttgataagccgacactacatgcaattcgtaatgtgtataaactgatttatcgcagtggcaaaacccttgaggaagtcattcctgaaattgaaaattatgcacaaactgaaagtgcggtgagttttttccttgactttttcactcgatcaacacgtggcatcattcgttaatgggtagcctaaaataatgttgtaataaaataggaatgaaccgcactttttttaagtgcggttattttttatggtgtttttatgatagataaaaaaaatataacaattggcattgtcgcaggcgaagtatccggtgatattctcggtgcaggtcttattcgagcgttaaaaatacaatatccacaggcacgttttattgggattgccggtaaaaacatgttggctgaggggtgtaaaacgttagttgatatggaagaaattgctgtcatggggttggtagaagtaatcaagtatttgcctcgtttgctgaaaattcgtcgtttagtcattgatactatgttagcggaaaagcctgatatttttattggcattgatgcaccggattttaatttggatatagagttaaaacttaaaaagcaaggtatcaagacgcttcattatgttagcccctccgtttgggcgtggcgacaaaagcgtatttttaaaattgctcaagcaacgaatttggtactagcttttttgccttttgaaaaagcattttatgatcgttttaatgtgccttgtcgctttgtcgggcatactatggcggacatcatcgatttgcaaccggatcgccaagatgcttgcttccaacttaatctggagccaaaacatcgttatgtggctattttagttggaagtcgagaggcagaggttcaatttttaactcccccctttttacaaacggcacaattaatcaagcagcgttttcccgatgttcaatttttagtgcctttggtaaatgaaaaaagacgtaaacagtttgaacaaattaaagcccaaattgcaccgcatttagaggtcgtttttctagatgggcaggcacgccaagcgatgattgttgctgaggctagtttacttgcctctggtacagcgtctttagaatgtatgctatgtaaatcgccaatggtagtgggttataaaatgaaaccttttacttactttcttgcaaagcgtttagttaaaacaaaatatatttcgttaccaaatttattagcagatgacatgttagtgcctgaaatgattcaagaggattgtactgctgagaaattagctgaaaaattatctgtttatttggagcaaacggaaagtgggattaaaaatcgtcaacatttaattcaacaatttactcaattacatcaactgattcgatgcgatgctgataagcaggcggcacaagcagttattgatttattaaatgatgaggtataaatgacgaatgcttttgtttatccgaatgtggaattcattgcaggcgttgatgaggttggtcgaggacctttagtgggtgccgtagtgacggcggcggttattttagatccgcataatccaattgaagggctaaaagatagtaaaaaattatcggaaaaaaagcgtttgcttttggctgaagaaattaaacaaaaagcgttagcttggagtttgggacgggcagaaccggcagagattgataagttaaatatcttgcatgccactatgttagcaatgcaaagagcggtagaaaatttgaaaattcaaccgcactttgtattggttgacggtaaccgtattcctcaattgccgatgtcggcacaagcggtgataaaaggcgatagtctggttgctgagataagtgcggcatcaattttagcaaaagttgctcgagaccaagagatgatagaactggatagacgttatcctgagtacgcttttgcacaacataaaggttatccaacaaaattacatttggaaagattagcccaattcggggtattgcctgaatatcgtcgtagttttgcaccggtgaaaaaattgttatcaactttattgtcaaaaaatcacgagtacgttttcaaaatacaaaaataaatattatgttagtacctgttattgagtataatgagaactcagttttcaaaaggaaataatatggctacgcttttaaaaattggcttagtttcagtctctgatcgagcatcacaaggtgtctatcaagatcaaggtattccggaactgcttgaatggttaaaatctgctctatgcgatccgttcgaagtggaaagtcgcctaatccccgatgaacaaaccttaattgaaaaaacactttgtgaattagtcgatgattgccattgtcatttggttttaactacaggcggtaccggtcctgtaaaacgagatgtaacacctgatgcaactttggctgttgccgatcgtgaaatgccaggattcggtgagcaaatgcgtcaagtgagtttgcattttgtgcctactgcgattttatctcgtcaagttggtgttattcgtagaaatagccttattttaaatttacccgggcaacccaaagcaattaaagaaacgctcgaaggtgttaaagatgaacatggtaacgtcattgtgaaggggattttcagtgcagtaccttattgtttgcaactgattgatgggatttatattgatacagatcccaatgtaattgaaagttttagaccgaagtcggcaagacgtactttatagttgaaaagtgcggtagcttttttattttgtttgaggaagatgatgaaaaaaattgaagcaattattaaaccttttaaattagatgatgtacgtgaaagtttagctgatatcggtattaccggaatgacggtaacggaagtgcgtggttttggtcgtcagaagggacatacagagttataccgtggtgccgaatacatggtagactttttaccaaaagtcaaaatggagattattgtgcctgatgaaattgtcgaacaatgtattgaggcaatcattgaaaccgcacaaaccggtaaaattggtgacggcaaaatttttgtgtatgatgtaaatcgtgtcattcgtattcgtacgagagaggaaaatgaggaagcactttgatgtctgaaagaaattcatcgctaactcaagtgctggttgcttgtgctgcaattatcgttattttaggtggcattaaactcgccggtgagattgttgtgccatttctattatcgttatttattgcgattatttgctcacctgtggtgaattttatgactaaacggaaaatacctcattggcttgcgattactttgctttttgtattaattgtggtgttattttattttttagccagtttaattagtaatactgttcaggagtttactcaatctattcctcaatacaaggtactgttgtcacaacgtttaaatgatttgttagcttttgctcatcattttaatattcctttatttttttctaccgatagtattaatgatgattttgatcctagcattatcatgaaatttgtcagtcgttttttgttgagcttctcgaatgtggtaacaaatatttttgtgttgtttttgatagttgtctttatgcttgctgaagcacctactgtaaagcaaaaatttactaaattaatcgttactgaaaatactgttactcaacaaaattatattgaacgtattctacaaggcgttatcggctatttaggcgtaaaaacgattactagtgtgatgactggattgtgcatttactttgttttatccgtccttgatattcaatatgctattttatgggctaccttggtcttcttattgaattatattcctaatataggatctatcattgcggcagtccctgttattgtgcaaagttttttattaaatggatttatcacgggtttagttgtcagtattgcatttattctgattaatactgtggttggtaacgttttagaacctaagatgatgggcagaaaattgggactatcgactttaattgtttttctatcacttttattttggggttggttattaggaacagtaggaatgttgctttcagttcctctaacaatgggattaaaaattgcattagaggcaagtccaaatacaatcaaatatgctgagttattaggtgatgtaagcgatgtgaaaaatgttaaatgacgaaaatttattttttatcagacwgtgccgtaaaaccacgtcctttagggcgtggatataaggcacaaatatgatatacttcttactgctaacagaggtcgctttagactctcaatgacggcataatcagggcaggacgtgcccgtagcgtctgtgaagtgaatcgcattggcggtcagcagcagaaacccwccgagagtagcccattgcttgcaatgggagctggtaggaatctccttgctttagcyaggggaggacgtcaattgacgcaatatatctacaaaaggcatctttcttttcagatgccttttatcttataaaaacttctttttgtactttactaagtcttttttatgtagtgcaaagacgcctattccgccatttcttaattctaaccattggaaaggcacctccgggaattgttcgattaaatgaaccatactattgccaacttcacaaatgagtattccattatcagtaagatagtcagcagaatttgccaaaatttctttagtaatagtcagtccgtcaattccggagcctaaagccatttccggctcatgatgaaattctataggcatatcctgcaaatcttcttcatccacataaggtgggtttgtgataatcaaatcatattgatcgagcggtaaatttttgaataaatctgactgaatagggaatacacgatgggtgaggttatgacgttcgatattgatttcagcaacatttaatgcgtcaatagataaatcaaccgcatcaacttctgcatgggtaaattgttctgcacaagcaatagcaatacagccacttccagtacaaagatctaaaattctgattgggtcttgttggagtaaccctttgaatttattcgtgattaaagcactgattggtgaacgaggaataataacacgttcatctacataaaattctaatccacagaaccatgcactattagttaaataggcgataggtaaacgttgctcaattctagcaataactaattgaatgagtgaatttttctctgaagtcgtgagtgctgaattataaagtttttcgggaaaatctagggggaggtgtaatccggttaaaatgagctgaagactttcatcccaagcattatcataaccatgcccataataaatatctgaacggttaaaaatgctataggtccatctgagaaaatcttgtattgtatgtaggctgttctgaacctgatctgttaaaatgcaatctacaagttcttggttaaattgatttatggtactcatattaaatttctcaagcaaataaacgatgtagttataccatagttattcataatgggtaagttaaatttaaaaatagggaaaaacatgttgaatgatgaagatatagaactttttcatcgtgaaattcaaggagcaaaaaagatagaacagaatatttttattgcaccacgtcatcgaaatttaaagaataaagttaagattcgcaatgttcgagaaaaagaagatacattatttttcttttcagatgaatatgaacctttattagatgaagaaagtgcggtgaaatatttacgtccacatgaagatcgttatttgttaaaacaattacgccgtggtgatttttcacctgaactttttttagatttacatggtttgacacgtaaagaggcaaaaattgagctggcaagccttattcatgcctgtgaaaaggagcatgtttattgtgcttgcattatgacgggatatggaacttatacgttaaagcaacaaattcctcgttggttagtgcagcatccaaaagtgagagctttacatcaagcaccaagggaatggggaggcgatgctgcaattttggtattgctggacgtttaaattatttattagtatcaagtttagatgtacgttgattttgcctaaaagccgtataaagtgcgggtaatatttggttaatcagattaagttgttgcaatggaattgcgacttcatttcgattgaactgatcagcatgttcatcactaaattgttttaaagaaaactcaatatttagcaataatttttcaaaattatctcgttctaaagtttcaatatgctcaaggacatgaagtaattttttggcgataggataaaactcccctaaaaacaccgcactttgctgaattttctgcatattttttctatatgcacctaaagcagaaatataactcagtagcgaatagttaattttgactagttcaaatccttcttgcaaataggcttgatattttttaggttcgctattcatgtttgatagggttgtacttaatgcggttgcatattcatgtgcttgccgtctggcaatacgatattttagcggatcacctttgccgaataatagttggctaatgatatataaaaagtatttagcattagcttttatcgcttgttttatcactttatttagttgtagatatttccaatccggccataaataagaaacagcactccaagcaataaagctgcctattaatgtgtcggttaagcgagataatagagcgttatttaaatcaaatctcatgatattaaagctaattaagacttgtagtgtaataaaaaaagtagagtagctataattattgctacggaaaaagaaaaacaatgtactagtgacgacaactaaacctaattgcaattctaaagttggatgtatgtaaggcaatagagaaccgattaccacgccaagaattgtaccaatgatacgttgttttaatcttaacttagtcgccgaataattaggttggcatacgaaaacagcagtaagtaagatccaataacctaattgcaaattaaatatttctactaaactacagctaacaaaaacaatgatggataggcgtattgcatggcgaaaaagttgtgattcaaaggtaaaatgactacaaattgtacgccacatattttttaaaccaatgatctgctctgtatatatttgcgttccttcagatcgttcatttgtattttccgaatattgatccatatggtgtaattgccaattaactgcctgtaaattgtcgattaatgttttaatggcaagtcgttgtaattgatttaagtgactgttttgataatgtatttcaaacgactgattaatacctaaaatcgcttgttccaaacgaggattgtacgaataggatttattgtattgcagactatgagcaatttcacgacaagattgtgcttgtagctctaataagcgttggatacgaaaaataagatccgtattttttaattgctctgataattgttgataattaaaatgacttgaattaattcgttcatgaatatcttgtgcagcaaaataatatttaatcatttttgtcgtacggcgatgtttatgttgtccacgaatgcgatgaaataatgctgtacgacaagcgttaaaggcagtaattaaattaccgtttttcatggcaagaatgacacgtttattttctaattgttcaatatcatcaggatcaaaaaaaagtgattttgtgtctaaatattctgataaagcaagaaaagcttttgtcatattttcttgtacagggcgatttggaaacattaaatgaacaaaaaccgtgcataaactataaagtaatgtgccacataaaattaaaatagggttgatataccaagaaacatttggtgtataagttaatgttgtataaagagctacaacgagtgtaccgaaagcaatagtgctataactttgccctatagcaccaaccatggtaaataaaaaggtaagagcggtcattaataacaaatattcaattccatgccctaaggtgagttgtacactaagagaggaaatagaaaaagcaattaatgtataaaatacatatttaagtcgtcctgttaatctattatccaaatcaaccagtccgcctgcaataatacctaaaattaatggcatagactgttcggaaatatttagtttccaaatagagaatgtcactatatttactgctaaaaaaacaggaatggagagaatgatttttgtattaatccaagggggcattttatattttttctaaactttttattattttaaccgctcttttaagtaaccttgatagtccggaatacgaatttcagtttcttgttggaatgcaggagaactaattaaaaaatcagcagtagcaatattcatcgcaacaggaatgttccaaacagttgcaatacgcattaaggctttgacatcaggatcatgaggaactgcattcattggatcccaaaagaatatcagcaagtcaattttgccttctgcaattaagccacccaactgttgatctcctcccataggaccgctaagtaaatttttgatttctaaattcgtttcttgatgaattaaatttccagttgtccccgttgcataaagaatatgaggttgaagtaaagtgcggttagtttgacaccattgtatcaaatcttgtttgcagtgatcgtgtgcaaccaaagcaatttttttgttttttgtcaatttgcgataggtggtttgcataatgatagtccttaataaaaaagtgagcttaggcccacttttgagataaaaaccggttataaaattatttttggttttttgcccaattgaggaagcgaacttgagtttctttgtcggcttgttgaaaccagaactgtaattgttgctccgcaatattttcaccttgcacgacgacttttcctttttgtgctttagtaaatccgagagcaacagcaggcattgccgttgcaaagctggaaactgaagcaacagaaccggatgcattatattcagataatgtatcaattaggttagcccctggaaggaaaccttcttgcttcaatatttcttgttttgtcgcaattatttttccgctatttgttttgacgatgacagacggtgaatctttaaaatttttaatatctcgttcattttccagtttaggggctgagataactacgtcttcgtttgtgccttgaaatgtaacaacaataggatctgattcatataaagaacgatctgagccatgacgaacaatttctgaaacacgaacgacgacttggtgagtttgcgattcattgatattaaatgatttagtagattttaatagatctttattagctttttgtccatcaatagctaagaaatctatgtttgatgaactggttactataccggcaaaagctgctgtacttgttaatagcattgcacttgcaagtgctgcaaaagaaaatttcataattgctcctatagcctcaggaaatataatataaacttatccgcttttagaaaaagctaaccctgtatcctattccaaattaaataaaatgggaatagaaaaaactcgattatttgatttttttctatttttgtagtgaataagtaaaaaaagaaagcaaatttacttcttagttttttttcatttagtatattcgagaagaaattttgacgctgtggaaaaccgaatcataaatgttcgaatcacgatagatagccattctcaaataaaccaactatatagtccctgattgatcaacccgctttactttttattcattttcgaatagactgcctgaagatgcaatttctcattgattcgtacgatttcttcatttctgtagggctacatatgaaaaaaatgtcggtattaatttggctttgcggtttttcatcattattgtcggcggtagaacgaccgctcctccaattaaatcgtattgattcccaacagcaacaacgccaaaaggaacaaattcaacagcaaagtgaacgacttcgttccgatcccgatgtgagaatggaaatttcttcagaaaaacctaccgcacttccctttaatgaatctccttgctatcccattcaacatctttccattgtagattattcctccgataacaagacaaaacctagccaatttcaatgggcactgaataaagctgttacgcaattaaacctccaattaccgcattgtttcggaactcaagggctagggattttgatgaaacaggtgcaaaataatgtgattgaacgaggctatatcacaaccagagtggttgccggcgaacaaaatttaacgcaaggcgtattttctttaacggttattcccggtcaagttcgccatacgattattgccgatgtaagtagtctcccttggtttagtaaactgacagctaaaaccgcattggcatttaaacagggagatttagttaatatccgtgatattgaacaatccttggaaaatctcaaacgtgtgccaactgcagatgccaatatcgacattcttccggctgataacagttcagcattcggtgaaagtgatattaaaatcacctatcaacagcggtttccattccgatttagcttaaatttagatgattcgggttcaacatctacggggaaatggcaaggctctgccaccctttcgtgggataatcttttttctgccaatgatttattctataccactttcacacatagcttaaaacgtcacagcgataattcggggcgtcgagcaacgagaaactatggcttctattattctgttcctttgggttattgggcactctccacctcattgtataaaacagattatcatcaagatgtttttggggcgtttgataatacttacctctatgctgggcgtagtgaaacaaccaatttaaatcttgcctatcgtctttatcgagatgcggtacgtaaaaccacgatttcaggcgggttttggtctcgccactcgaaaaactacattgatgatgctgaaattgatgttcaacgtcgccgaatggctggttggcaactcaagcttagccatattgaatatattaaggcagtaacactgaagctttctctaggatttaaatggggaacaggtgtaggtcgcaccatagcggcaccggaagaatattggggaaacggtaattctcgtcctaaaattattaccgcctcggtagacgttaattatcctttctatatggggaagcaacccttggcatttaatacgaattggtccgcgcaatggaataaaacccctcttattcaacaagatagattgagcattggtgggcgttatacggtgcgtggatttgacggtgagcttaccttatcgggcgagcgaggttggctatggcgtaatgaactcagttggaatattgcaaataaaggacattgggtttacttagccttagatggcggtagagtgatgggacgtagtgatggaatacgattagggcatcatttaatggggacagttttaggtctgcgtggtagttggacgcatttttattatgatgtatttattggacggccattaagcaagccgagcggttttagaacatcgcataccgtaaccggctttaatatcggcttaaccttttaatttagtgcattaggctcaaacgaggattttcttatgaataaacgtcagtttcgtgtgatttttagcaaaacattgcaacctactgtcgtggtttcagaaccggtaaaaaccgaaggaaaaacaaaaagtgagatgcctcaaatgcaaagtgcggttaattttctacccatttttgccaccttaactccccttgtctttcgtttattctgtgctttgagttttgtcttttcctcgtctgtatttgcggaaaccttaatcatcaaagccgatcccaacgctcccaaaaatcaacaacctattgtgttgcaaacagcgaacggattaccgcaagtcaatattcaaaccccgaatgataaagggctttctcataataaataccaagattttaatgtagacaaaaaaggggcgattcttaataacagccacaaagacacacaaacacagcaagcaggttgggtacaaagcaatccttatcttgctcgtggcgaagcaaaagtgattctcaacgaggtaacatctacacatccaacccaacttaaaggttatgtggaagtggcaggcagaaaagccgaagtgatcatcgctaatccaaatgggcttcattgtgatgggtgcggtacgattaatgcgacacgctcaacaatgaccacaggcaaaccgcagattattgatggacaagtagaaagcattaacatagaaagaggcaaaataaccatcagtggcaaagggttagataacagtcgtgtcaattataccgatattcttgctcgagaagcggaaatcaatgcaggcatttgggcgggtaaaaagctcaatgtggtaaccggcaaaaacaccatcaaacagacagatatggaacatggcggaaatgatttacaaattatccacattgacagccaaaatctcagtgaaaacgcaccgcactttgctttagatgtgagtgagcttggcggcatgtatgcggggaaaattcatcttgtcggcacagaacaaggactgggtgtgcgtaatgcagggcatattggggcaagtgcggataatttagtgattgattcacaaggtaaaattgtcaatcaaggaatgatttctgcgaagggaaacctacacgtcagtacgaaaaaagaaattcagaaccaagggcaattactcaccgaagctcagctaagtaccaaaagttctcatttggataaccgtggcggtaagattgaaggaagaaccgcacaaattaatgcgaccgagacagtgaataatgatcgcataggttcaacaggatctttgattcaaaccgctgaaaaacttgatattcatagcaaactcgttacaaacaaaaacacgaaagcgtcacaaagtaagcaacctgaacaaggtattattgcaggtgtactgacaataaatagcgatgctcttgccaatcaaaacggggcaatttatggcatgcaaaatgttcaacttaatctttcagggcacctgcataatcagcaaggcgaaattctctctcttggtgagttacaaattcaaggcgataaacttaatatgaataatgaacaaggaaaaatcgcaagcagaagtaatttagctatttatgccagtaaattagaatctgaaggagaaattgaaagtagccacaatgcgagtattcacctcaagcaagatttaacgcttaataatgcttttaaagtgagcggtaatttagattttcaaacacagggcaattttatcaacaactcagttcttcgtgtgggagagaaactaagcatacaggctcataatatcaataataacagggagagtgagctatccggtaaaaatacccaaattctcagtaatgaaataattaatcgaggattaattgatggtgaaaaaaccttattaaaaagcaccgcactttctaaccttgggacagggcgaatttatggcaatcatttagccattgcgacaccaaatcttatcaatggcaaagaagacaatgcttcgccaaccatcgcagcacgtgaacgattagatttggcggtcggttcacttaccaatcgtgatcatgcgttaatttttagtgcgggagagatgggcattggcggtcatcttaatgaacagcaccatgctgaggggaaagcttcattcattgataatggcagtgcgactattgaggctttgggaaatgcttatgtgaatacagcacgcctacaaaatcacgacttacacttgcgattgggggaaaatcacaccgatgaacggcgagttgaatatgcaccgaaaaatacgtctcgacgctatgtattgatagataaagatggcaatcacgggcgatttgatttaaaaaataatagtaggagcgatagaaattcttatttaaggctgaatgacggcacaaccattgcggctaatagttggatgcattgggattataatcgccacactattacgacaacgattgaaaaacgtgatccggctaaaattttgattggcggtgatcttcatttatcaggcaatgatcttgaaaataatgcgtctactctttctgtaggaaaacgcttattactcggtgatgaggtatttataaaaaatgataaaaatgaaacgttgcattccacaaccggtacatcgctcaataatattgatattgcaggaacgataaatgttacggacaaaggacattgggatagcttccataaaaagaaacgtcgctatggaataggggtaaggaaacgttgggcggtttatggtaccggaagaggggatttgaatgacattcacccgacgagccatttcttcttcaataaggtagataatactatcggtcagcctgttgacagcaccaacacgaaaattacagctcaagctgaggcgattatgccaaaccaaatgaatggcgtaattattaacttaccggaacaaagtctatatcagattaaccccgatgcccctaatggttatttagtggaaaccgatccgcactttactaaccgtaaacaatggcttagctctgactatatgtttaacgcattgcgttccgatcacaaaaatgtgtagaaacgccttggagacgggttttatgaacaacgcttgattaatgaacaaattcatcaactcaccggacgacgctttttagataatcaccaaaccgatgatgagcaatacaaagccttaatggatagcggtatttattatgccaaaaaatttaacctgcacctcggtgtcggcttaacagcggagcaaatggcagagttgactgcggatatggtatggtttgtgaataaagaagtcatactgccgagcggtaaaaagttgacagttctcactccacaagtttatcttgttgcacgaaatcttgatgtaacttcacaaggtgctttaatttcagcgagagaaattatgggtaatattaacggaaaacttaccaatacgggaacgattgcggggcgaaatctgaccgcactttctgccaagaatatcaacaaccaagggcttgttttgggggattccgtcaatttacttgcaaagcaaaaattagttaacctcggcggtagaattgaagctcttgattcagtgacattagtcggcaaagaaggtgttgacattgcaagtacaacaactcgccgagcttatcaagatgactttggtaataaatttgaccgcactcatgtagataaccttgccggtattcatgtcaaagataaaaacggtaaattaattgttcacagcccaaaagatgtaactattaaaggtgcagaactcaatagtgcaggcggaatacttgttcaagccaaccatattgatattggtacccttaatacaaaaaataaaacggattacaatgcggatatggataattactaccgcttagaacagcatcaagaagtcggttctcaattaaatggaaaaggtaatatcacccttgccggtgaacagggcgttgtgattcgccaaggggaaattcatagcgagaacggtgatgttcatattgcctcaaacggtaatattcgcattgaagaagggcgtaacaaagagcggctttcttctgcctctaaagtgaagcatagtggttttcttcaatccacgacagatatcactaaacacgagcaccattatgatttagctcaaggctcaacccttgacggtaagaatgtggtgttgcaaagcaatgctaacctgacggttcaaggctcaaatattgttgctgaaaatcagctcaatgctcgagcgaaaaacatcgcaattaaggaagcagaaaaccgtgttttcgaacaagatgttgagaaaaccacgaaatcaggcttaatgggttcagggggatttggctttagcattggcgaaaagaaaaacaccacagaaaccaatcaaaccaaatattacgctacaggtagccaagtgggaagcctgaaaggtgataccgcccttattgcaggcaaacactaccaacaaaccggcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaatatcagcggacagatgacggtgggctatggcttttccgcctccgccaacttcaatcaatccaaaatcaacgccgattatgcaagtgtgcaagaacaatcggggatttatgcaggagatgaggggtatcaaattaacattgcccaacacactgacctcaaaggcggcttaatcacctccaccgcccaagccgaaaaccaaggtaaaaaccaattcagcacaggtacattttcttattcggatattcaaaatcacgctgattataatgggagtgcggttggtgtaggagtacaagcagatattaacggtggctgggacggtcgtcaggttagagatggctcaccggtaagtcgagtgaatcaaggtatcggctttggttatgacaaagacagccaatccagcctaacaaaaagcggtattaatacgcaaaacctcatcattcgtgacgaacaaggacagttggcgaaaatgggaaaaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtacccttaatacaaaaaataaaacggattacagtgcggatatggataattactaccgcttagaacagcatcaagaagtcggttctcaattaaatggaaaaggtaatatcacccttgccggtgaacagggcgttgtgattcgccaaggggaaattcatagcgagaacggtgatgttcatattgcctcaaacggtaatattcgcattgaagaagggcgtaacaaagagcggctttcttctgcctctaaagtgaagcatagtggttttcttcaatccacgacagatatcactaaacacgagcaccattatgatttagctcaaggctcaacccttgacggtaagaatgtggtgttgcaaagcaatgctaacctgacggttcaaggctcaaatattgttgctgaaaatcagctcaatgctcgagcgaaaaacatcgcaattaaggaagcagaaaaccgtgttttcgaacaagatgttgagaaaaccacgaaatcaggcttaatgggttcagggggatttggctttagcattggcgaaaagaaaaacaccacagaaaccaatcaaaccaaatattacgctacaggtagccaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaattggcagaagggttggattcgttgacaaggactacctcttttggttttggggcggatagtgatagtcaacgaagccaaacaaaatcaggcattaacaccacaaatatcgcaattcgtgacgaacaaggactggttgaaaaaacaggtaaaaccgttgaacaagtgaaaacggaaattaaaacgggcattgctaccgacaatgctgaaagacgttcgggtaagctggaaaaccgttttgataaagatgagctacaaaaagagttggattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaagagaaagaaaccgtgacctcgataatcggtttgctgggtgctgcaataggcacaacagtcggcaacagctcaacaaacgcagtacaaggcagcctgaatgcacaaagtgcagtggagaataatagccttcatgttgataaaaatggtgtagttattcgtaatatttctaatgatgactacaatatttatcaatatgattatgcttgttctcctgttgctggaaataattgtcctaatttgaaagattttgatgagttgtataattcccccaaaaaagttgtaggtcaagtaatgtggcaggactcatttaccagtccagaatcaggaaaatctttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatttaaatacagcaacagagtttgtgaataacttaaataatcaaggtgatgaaattcattataagatggaaaaaaatgaagactctcttttttctatccaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtaaagttgcaacagcgggaatgctgaatctgaaacgagaagacaaagtatccagtgcaattttatacgataaggatttggcttcaattgatgaaaccgcagttattttaaatcgtggcagtgcgggtatgttaaatgaatttatctttactggatttgaacgtttcagagcgtgggcaaatctaccgagtatcttcggtgcatcaaatgcgacgagagatcacgctcagattgcgaaaaaactggatgaatataatacttacgcagaatctcayggaacaaaaacatatacatttaaaaatgtagcwcmtagtttaggygtwtcrkgyaataaraatatgytgaattggtcggagcatcttggtcagaaatatgaacatactgatgtagaatatttacatttaggcggttcatatccgtcaagtgaaatagataaacaatcgaggagattatttaagarcgtcaaaacacagtatcatggcgtaaagggtgattttgtctatgagggaatacccattttaagaaatttagggttgggaatgattggaaataatcctaacgcaacccctaataaggcaaatktgtctttcttagatgctcattccgaagccaatcagaatattaataatttaaagtttgtttataaatcagaagaaaatggaacgaaaactaaagaatggttaacaatagaggatatgttaaaaaagacatatcctgaaggaattagaaaatttaatgaaatcaatgaggctagataagatgaaaagatttgtttttttagtgttttttttgttgtcaggttgttctgctattatctctttatatcctagttatactcaggatattatgcatggggaaagattttgggtaaaaaaaggaaccaaggaacaagtcagtgaaaaaacgtatatagcttgttttcataaaggcttacaatttgatttaaggcagaaaaatcttccgccagatgcgtctggttgggattggtataacgttgctttatatcaaggtaaatgtttgcatgatttgggatatgtttttaaagaggatatattgtcaaaatattgctaccattacataaatgaagttgattgtagagcatatcgaaaatttaagtattagtttttttgcaatttgatattattttaattcttacttttttctatatcagtataaaacggtagaatgcaatcatatttcttgaatatcagcggacagatgacggtgggctatggcttttccgcctccgccaacttcaatcaatccaaaatcaacgccgattatgcaagtgtgcaagaacaatcggggatttatgcaggagatgaggggtatcaaattaacattgcccaacacactgacctcaaaggcggcttaatcacctccacagaaaacgcagagacggaaaaccgcaaccaattcagcacaggtacattttcttattcggatattcaaaatcacgctgattataaaggcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcggctttggttatgacaaagacagccaatccagcctaacaaaaagcggtattaatacgcaaaacctcatcattcgtgacgaacaaggacagttggcgaaaatgggaaaaaccgttgaacaaataaaaacggaaattaaaacggacataaccaccgacaatgccgaaacccgttcgggtaagttggaaaataaatttgataaggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnataaacttggcagtatttcagatttatctgttgaatcttttgcgggtacacacgatatgtcaggcagtcaaatttggggttggtatgacaaattagggaatacagcccctaaaacaccaatgcaagatacgtcatctaaagcaacaactataattgctattcctatatctgcaccttttgccgtagcagatctcatgtctgctgatttttttgaagttttaatgaaaatcggaggtcaataaaatgaaaaaagctgtctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaagaaaaataagaaagtattggctgaaatcactatgtatagaagctacttttagnnnnnnnnnnnnnnnnnnnnnnnnnnnnnntaaaaacttgattttaaatggtgcccgagggcggacttgaaccgccacagctcgaaagccgagggattttaaatcccttgtgtctaccgatttcaccactcgggcgagtgttccgactcggttatgtgatggaggcgtgtcccggagtcgaaccgagctacatggatttgcaatccagtgcataaccgctttgctaacacgccgtagcgtaaattggagcgggaaacgaggctcgaactcgcgaccccaaccttggcaaggttgtgctctaccaactgagctattcccgctttttcgctgcaacacattcgctgtcagtggtgcgcattttacttcgttatgaaaaactgtcaacaattcttttgaaaaaatatgttaattgatgaaaaaaaactcaaaacaggtatttaagaatacaatttatacagaatgtgtttgtttttagtacatcactatcacttatttcatttatctattttaatgatatagaaaatattctttaatcactggaaactttgtgcaacaatgcaatcctattatgtcgtacaataataaaatatagctaaaagtgcggtcgtttttcttagattaattaggtgaagttatgacacaacaatatgctctagatacattactggctcaggcaggtaatagaacagatgaaagaaccggtgcggtatctacgccgatttttctttccactgcttatgctcatcatggaattggtgaaagtacgggatttgattatacccgcactaaaaatccaacgagaacggtattagaagaaacaattgcaaaattagaaggtggagatcgtggatttgcctgttcttcaggaatggcggctattcaattattgatgaacttatttgcgtcacctgatgaatggattgtttccagcgatgtttatggcggaacttatcgtttattggattttgcccataagaatacgcatggtgttaagcctgtttatgtcaatacagcttcaagtgaagaaattgaaaaggcaatcactgagaatacaaaggcgatttttgttgaaacgccatcgaatccgttaatggaagaatgtgatgtggcagaaattgcgaaaatagctaaaaaatacaatttgctattgattgtagacaatacttttttaactcctgttttatttagaccaatggaacatggtgcagatattgttattcatagtggaacaaaatatattgctggtcataatgacacattagtagggttaattgttgccaaagggcaagagatctgtgaccgcttatattatattcaaaatggtgcaggtcccgtattatcaccttttgattcttggttgaccattcgaggcatgaagacacttgcattgcgaatggaacgtcatcagaaaaatgcacaggaattggcaaactttttaagagaacagccacaagtaaaagatgtgttatatccaaataaaggagggatgctatcttttcgtcttcaaaatgaaaattgggtaaatccttttcttaaagcaatgaagttaattacttttgctgagagtttaggcggtacggaaagtttcattacgtatccggcgacacaaacgcatatggatattcctgaggttgaacgtgttgctcgaggtgtatgcaatcgtttactacggttttctgtaggattggagaatgtagaagatattaaagcggatttattgcaggcattttctcaactaaagtaaccgcactttaatagatcaagatttaataaaagtcgcaacttatcatacgtaagtaatttgtcgtggtttatgttgtgatttttcacttgaaaagcggagatttatctttatactctctaactggaaataataaatcccaaacaataaaaggaagaaaaataaaaatgagtgaagtattacatacaacagatgcgacttttgatactgatgtattaaaatcagatattccagtattattagatttttgggctccttggtgtggtccttgccgtatgattggacctattctagaggaactttcagctgaattaggtgataaggtaaaaattgttaaaattaatattgatgaaaatcaagcgacaccggctcaatttggtgtgcgtagcattccaacattaatattcttcaaagaaggtaaggctgtcgcaactcaggttggtgcattaccaaaaaatcaattagtaaattttatcaaccaaaatagctaatatgtagcttaagcaagacgaactaaaatagcttaaatctcaaaaggatttaagctattttgtctattacacctttaaatcgtatataaaatcataaaacattacctttggtaacggttaaagatttaatatttctttcacaaaaggaatagtcaacttacgttgtgcttgtaatgaggctttatctaataaagttaatgtatcaaataaagatttaatatcacgatctaaacgttttaataaaaaattagctgtatcatcaggtaattcgatccctcgttgatgggcattgcgttttatcacttctactttttgttgttcatttagtggatttagctgataaatttctccccaacttaatcgtgaggcaagatcgggtaaagagatatttaaattcactggagattgattggcacttattaacagtaatgtactcccgctctcttttattctattcattaaatcaaaaatagccaattcccattcatgatttcctattattgcatggaaatcatctaaacaaaccaactcttgctgttctaaattttccaaaacttcaggggaaaaatattgtgctttactcaatggaatataaatcgcattgcgttgcgatgctaaaaaataattggaacacgctttaagcaaatgagttttacctgtactttttcctccaaaaatgtaaaagaaaggttgatataattgaataaaatttttacgtaatgaaccgagtaacaataaattattgtcgctacaaaaattctctaaggtatcatcgtctatttgatgaataggcaaagggagttgttggctcaaaaaataattccatttgatagtaaagttgactcataatacagaaaaaataggaacaggtgaacctattcctattaatcttgtaaattttagtcttctatttgatttttagccgatggtaaaatgagatttagaataatagcgacaacggcacataaactaatccctttcaaggataattctcctaaattgacaaacattccaccaattccaaaagtcataaccacagaaataatacataaattacgtgcttccgtcacatcaactttaccacgaattaatgtactcatcccaacgacggcaatagagccaaaaaccagcatcataattccgcccataacgaaggtggggatcgtagataggaatgctccaactttgccgcaaaatgaaattgcaattgcccatactgctgcccaagtcataatagtcggattaaaatttcgggttagcattactgcaccagttacttctgcataagtggtatttggtggaccgcctaatagtgatgcagcagatgttgcaagaccatcacctaataaagtgcggtgtaaccccggattttttaagaaatctttgccggttacagaactgatagccatgataccgccaacatgttcaactgccggtgcaatcgctattggtagcaaatataagatagcttccagtttaaattctggtgtcgttaaattcggtaaggaaaaccaagatgctttggtaataggactaaaatcgattaatcccataaataaactcaagatataacccaccgcaatgccaaacattatcggtattaatttcatcatacctttggcaaaaacagccacaattaaagtagtcaatagcgtaatcattgacacgagaaccgcatcaccatattcatagttactgcctttgccggtcgccatatctacagccacaggtgccagtcctaatccgataatgataataacgggtccaacaacaaccggaggaaaaattttctgtaaagcccccgctccacgtaatttaaccaacaggcttaaggcaacataaacaagtcctgcacaagcaagaccacccattgttgccggaattccccatgaggctacaccatattggattggtgcaataaaagcaaaagaagaggctaaaaagatcggcactttcttgccggtacatagttggaaaagcaatgtaccaattccggcggttaataaggcagtatttgcgtccaatcctgtgattaatggaactaataccaatgcaccgaatgcaacgaataacatttgcaagccaataaaagcttgtttgattttgcccgaaatttctacggggatattttgatttgtcatttaagtttcaactctctgtctgaattaactaaaagtgcggtctattttccaatagattacgcggaaaaaagcggcattaattgccgctttgtattttggtcttatttcgtaccaaaaatcttatcacctgcatcgcctaatcccgggataatatagccattctcatttaaatggctatcaattgatgcagtatataattcaacatcaggatgtacagcctctaaagctttgatcccttcaggtgcagcaactaagactaggactttaatatgctgacaaccttttgcttttaataaattaatagtcgcaatcatagaacccccagtggctaacataggatcaacaacaattgctaagcgttcatctaaatcacttgctaatttttgaaaataaggaactggttctagagtttcttcatcacgatacatacccactacactgatgcgggcacttggaacatgttccaatacgccgtccatcatacctaatccggcacgaagaataggaacgacagtgacttttttacccttaattcgatcaatttcaacagcaccacaccaaccatcaattatcactttttcagtttctaaatctgatgtggcttcataagtcaacaggcttcccacttcagtggctaattcacggaaatcttttgtagtaatatccgcaactcgcatcaaacctagtttatgttttactagtggatgtttaacttcaacaattttcatcgcatgtttccttattgatcgattatgtaaaaaaaatccaaacggcggaattctaaatgatcttgattaaaattaatagtattgaaagaatgttttaataaaaaactgcaatatgcagctgcagaatatttattttaccttaggcaaactgttgcatgcctagagtgccgtcatcaatgatttcagatgctatgcctaagatttctgctactttatcaccttctttaaacatcacaaaaccgccagattccattttattccaatgttcatctttggtaagtgggaacgttgtaataattgttactttatctgtttcttttgcatagtcacgaaaatcaataatattatcatcgtctatgcgttgtgcttttccgaaaggtgccttacgagtgagatagtgtaaatttgttgaacagtgggccatcatccactcaccattagataggataaaattaaatgtgcctctctgtgttaattcttgtgtgagtttttgaattgcactaaacatatcttgttcattaggctttttgggaaaacgtttctttagttggctaagcatataacaaaatgctgtttcggaatccgtcgagcctatcggttgaaaaagactttctgtcatatcgggtaatgaatttaagttgccattatgagcaaaaacccaattttctccccaaagttcacgaataaaagggtgagtattttcaatattgacttctccttgtgttgctttacgaatatgtgcaacaacatttaaagattttatgttgtattgtttaatacaatcagcaatgggagaagaatgtccgggacgattgtcgcgaaaaacacgaattccttttccctcaaaaaaggcaattccgaaaccatcggaatgacaattagttaatcctgctcttcgacgaaatccctcaaacgaaaaaacaatatctgttggggtattacaattcattcctaaaagttgacacataatttatttcatttaacccaattttatgtctttttatctacacaatgagtatgaatttaacaaaaatacagattaaaaatcaacatggatcttagatcaattagttacataaaatagctgaaaaaacttaccgcaccaagttttcacaaggtgcggtaagcaaataagaaggtttaatataaaatgataaggattagtaaacaccttgtgctaacattgcatcagctactttaacaaagcctgcaacgtttgcacctacaacatagttaatattttcttgcccttcgacagtaccgtattttttacaatttgcatgaatatccaacataatacggtgtaatttttcgtcaacttcctcagctgtccagtataaacgttgtgagctttgtgccatttccaaaccggaagttgcaacgccaccggcatttgccgccttaccaggtccaaataaaacgcctgcttccaagaatgcgtcggtagcttcaattgttgttggcatattggcaccttctgcaacaagttgaaccccgttggcgatcaattgttgtgcatcggataattccaattcattttgggttgcacaaggtagtgcaatatccgctttcactccccaaggacgagctccctccacgtattgcaaaccaaattgttcagcgtaatctttaacacgaccacgttttacatttttaatatctaaaagtgcggtcaatttttcttgtgtaaagccttcaggatcataaacatagccggagctatcagaacaagtgacaacttttgcccctaactgcaaggctttttcgatagcatattgagcaacgttacctgaaccggaaaccactactgttttccctgcgaaagattgtcctttttcagcaagcatagcttgagcaaaataaactaaaccataacctgttgcttccggacgaattaaactgccaccaaatgacaaacctcgaccggtaaacacgcaagctgcttggttagataattttttcatatatcctgcaagataacctacttctcgtccacctacaccgatatcacctgccggtacatcggtatctgcaccgacatgacgatataattcagccattaatgcttgacaaaaacgcatgacttccgcatctgatttacccttaggatcaaaatcggaaccacctttaccaccccccattggtaaggtagttaaagcatttttgaaaatttgctcaaagcctaaaaattttaaaatagataaatttacagatggatgaaaacgcattccacctttaaacggtccaatcgcactattgaattgaactcggaatgctcggtttacttgcacttgacctttatcatctgtccaagcgacacgaaattgaaatgcacgttccggctcaactaaacgctccaataaagcttcagagcgatattttggatttttctctaaaaatggccaaatggaagtgaatacttcacgtactgcttgcaaaaattctggttgatgaccgtcacgttgttctacttttgctaaaaaatcttctaacgatacgattgctgacataatttgtttccttcttaattgaaatgttttgtttgcttatttatatagagagcctttatcagcccgcgattaatatgcaataaaatatcaaaacattgcaactaaaattattaaaaaaaattaaaaaactatttaaatattaaattttatttaaaataattgtgtatattttaaatttattttgattttagttgggttgatagaagtaatatcaaaaagcaggaggaaaaaactaccgcacttatatattctaaattgaagaatttacagcaaaataaaaactggagactatatttatctttatatgttaagtaaaaaatgtaaatattagtttcattttgaagaaatttattacacactatatgggcaaattattttgcaactatttttactttaggagttattatgaaaaaagcactattaacagcattagtattaggcacgagtttaactgtgactggttgttttgataaagacaacaacgtttctcagcaagcagaaagtacaaaagaaagtgtatcaacagcaattgctgaaacaaaagaagctatgtcagaacaagtaacggaagttaaagagatggcgactgaaaaagtggaagcagctaaagaagctatgtcagaacaagtaacggaaattaaagagacagcagctgagaaagttgaagcagctaaagaagctatgtcagaacaagtaacggaaattaaagagacagcagctgagaaagttgaagcagctaaagaagctatgtcagaaaaagtaatggaagttaaagagatggcgactgaaaaagtggaagcagctaaagaagctatgtcagaacaagtaacggaaattaaagagacagcagctgagaaagttgaagcagctaaagaagctatgtcagaacaagtaacggaaattaaagagacagcagctgagaaagttgaagcagctaaagaagctatgtcagaaaaagtaatggaagttaaagagatggcgactgagataaaaagtgcagtagaaaaatagtctatattgggttagattttctttaatgattagagctagaatgattgttttctagccttttttcttgataaattgagattaagtttgtctttttatccaaatttgttagaatcagtcagaattttggggctgattttggattcgacggaattagcgaagcccaaggtgcacgtcgaggtgcggtaggcctcgtaaataaaccgcaaaacaatagtcgcaaacgacgaacaatacgctttagcagcttaataacctgctcatagccttcactccctagctttcgctcgtaagacggggataaagtggagtcaaatccaaacgagatcgtgttgaagccgccgctttaggatcgaagcattaaattgaataaagctagttttttgatggcgtgtctgtccgcagtcaatttacgaaattaaagattagactaaacgtgtaggactgaaggtagagtaatttcggacgggggttcaactccccccagctccaccatatcattcgaaaagaaaatttctagacattttgaaccgcattgaaaatgccaattttggcgtaactttttgtttttaatctttttagtgaaatttgttaacaacttaattttattaacaaaatttatttggcttttagaaggtttatggtacatcttgttaagatgttaaagaaaaaccgaaagaaaaacatttactaattgatggctaagggttgttctgaaaaactaagtttggcgatgttaaaatttgactaattaactctattagaagctagttatatcataactagcttctcgtttttatctccaaattaaattactttttcttgtaattgtagtttggaatagcggtccagcgttttttgaattctttaacgacttgttttggttgacgattgcgtgagaaaagccctttatggtttccttgtatacggtaaatcataaggtttgtttcaaagtctgcaaaattccatacttgttccccaacaagattagggatgctgtcaaaaacactatggctcatagcataaaaatcacattgaaactcttcggtataaggaatatcccacatagaatgtaaaccaggtaaagtatctgcaccatattctgtcataagaattggtttatctgggaatttactttgccattttaacaactcttgacgaagtccagcttctcctttagctaaatcaccatgatctacataccaagcatagtatcgattcaaagaaatgacatctaccaaatccattacttcatcacgctctggcgttgccagtaaaatattgactaaggtaacaggacgtttttgcggatccaattccttataaagagcaactaatggtttgaaataatcatgagcacctgcttcatggctggctggttcatttgctactacccacatgacaactgaagggtgatttttatcacgttttaccaattcttgaatcgcttgttcatgtgcttctcgggttttcatagcagaccaagttccgttatctttgggatttaaatcaagagaagcggtaaagttttggaaaagtccaacggctggaatttcatcaattaccaaaactcccatgcgatctgcaagacgcatcatttcttcagaataaggatagtgtgaggttcggaaagagttggcaccaatttctttcaaaaggttcatatccatcaagtttgctgcttcgtttaaaccgcgaccattgataaaagtatcttcatgttttccaaaacctttaaaataaacaggtttttgattgacaaagaattgaccatctgccacatgaacactacgtacaccaaatggctcatcataggtatcaacaactttaccatcaacaagtagctcaatatgtgcggtataaagataagcatctaaaacttcccataagcgtacttgttcgagagtgatatgcccgttacttgattgtgcaactacttgacgatcttcatcaagaatagttacttggattgtgtcaactgcctttgatgtttcaacagcaatagaaagttttgccgtctttaagtcatctgaaagctcactgacgatggtaacatctgaaatgtgaattttaggacgtaccattaattttacggggcgatgaattcctgcatagttgaagaagtcaaagttttctttaaccacttttttaatactgccatcttcttgagtctcttcaatgtaattaccaacaggaagtgtggtgtaatctaagatattattggcacagacagagatttttatttgattttcttggtaaagatcctttggaataattacctcaaacggagtgaatccacctttatgagaagcaagttctcgaccgttaacataaattttggcattgtgagttaccgaaccaaagcgtaaaactaactcatcattttccgctaatttgggaatatccacccaacgctcataccaaaaatctccaatataattacgcttatctttgtcaaccaccacgtcattaaaggaagttggtactaccattacttcttctggtgataaatccttttcgggattatgctctcctagtttaaattgccataaaccactaaggtcatataaacttcttgtttttgttaacgttggatataacatatattttctcctttgtgtttcttaacgtttaatctcgtgggaagtctcatctagcaattgatcaatatctgcttgagaaatcacattaatatcgccttcaatggtatgtttgaacttgaaacttgccatagcaatggccaaacttttttcaggactttcttttttaagcatgccatgaataattcccgctgtaaaagcgtctccagtaccaacacggtctaacacttgaatgcctgatttgtctgtctgataaagatgaccatcctgatataaatagcctttcaatagatattcattagtatgtcccatttctctttgagtaaaagcaaagcttttcacgctataagttttagctaatttatccaaaatgctttttaataattcttgatcttcgtaaggtcttgttaaacctaattggtcttttaaatctccttgcccatcaccggaaagacttaacggctcaattccaatgcaaacatctgctagagcggcaagaggggacaataattctcttgcctcttggaaagagttccataaacttgctctaaaatttaaatcaaaagagacagtgagtccctctgctttagccttggtcatcaaataatgggttaagctataaaggttatcattcaacgctggagtgatgccagacacatgaaaccagtcggctcctttgaatacagactctaggtcataatcactcagttgagattcccaaaaagcagagtgttttcggtcataagttacccgactggctcgtaaggaaaagcctttctggtaataataaatccctagacgttgccctttttccaaaatgtaatcctgattgatttgacgagaaaaaagaaagtttttcgtcatcctacctaaatcattatccggaatggcagatataagagaaacgttgtgtcctaattgtgccaaggttgaaagaacatttaattctgaaccgccaaattgacattctagactggttgtcagtgttagggtttgatactgtggtggtgataaccgtaacaagatttcacctaaagaaactactgttttcaactaaaacctccatcttgatgggttgtgctaaaagtagtatacacgatattatgttttttagtacaagaaagtgggctacagtaaaaaataagttatatcatcatcgtaacagactgcttatttagaattcttaatatctattagattattagattgttattcgcattgatttgtcgataatcttcaatgcagtgatgttttaaaaaaacaagcatattctctttataagatatttagaaaaatcttttttgttttttgtcgtgtggagtgacaaaagtgcggtgtcttttggtgtgtccttagaaatactttacaagtgttgattaaataagttcaaagatagccagcaaaagaattattttagaaatgcagtaaaaattatcatttatgccatagaaatattaacagaaattagtaatttaaattgagattaacgacagaaaatagtaaagtagcccactattcattcacttacaaaaatagcttttaaggcggaatttatgggaaaaagtgttgttgttttaggtgctcaatggggcgatgaagggaaaggcaaaatcgttgatttattaacagatcgagttaagtatgtggttcgctatcaaggtgggcataatgcggggcatacattgattattaatggtgaaaaaacagttcttagattaattccatcaggtatattacgtgaaaacgtaacctgtctgattggaaatggggttgttctttcaccgacagccttaatgcaagaaatgggggaattagaaagtcgtgggattaatgttcgtgaacgtttgttaatttctgaggcttgtccgttaattcttccttaccatgttgcaatggataaagctcgtgagtcagctttaggcaataaagcaatcggtaccacagggagaggtattggtccggcttatgaagataaagttgctcgtagaggtttacgtgtcggcgatttatttgataaagaattatttgccgagaaattaaaaaatattctagattactataattttcaattggttcattattacaaagccgaagctgttgattatcaaaagacgttggatgaagtatttgcagtggcagatattattacggctatggttgcagatgtttcgacaattttagatattgctcgtaaaaatggcgataacattttattcgaaggtgctcaaggcacaatgttggacattgaccaaggtacttacccttatgtaaccagttctaacacaactgctggtggtgtatccactggagcaggttttggtcctcgtcatattgattatgttttaggtattattaaagcctattgtactcgtgttggtggggggccatttacaacagaattatttgatgatgtgggtgcggaaattgcacgcaaaggaaatgaatttggtgcagtaaccggtcgtcctcgtcgttgtggttggtttgatgccgttgctattaagcgtgcaatccaaactaattctatttccggtttttgtatgaccaagctggacgtattagatggatttcgtgaagtcaaaatttgtgttggctacaaaatgcctaatggtgaaattgctgaatatgcaccgttagcagcaaaagattgggaaagtgtagagccgatttatgaaaccttaccgggttggcaagaaaatacatttggtataacagatgttaatcagttaccggaaaatactcgtaattacattaaacgtattgaggaagttacgggcgtacctatcgcgattctttcgacaggtcctgatcgtgttgaaactatgattttaaacgatccttttgcggtgtaaatcataaataatagagacaaaagtggtttaattcagaaatgaattaagccacttttttatctcaatcaacttcctgaaatcttcattttttccaacaaaatcgaacctgtttgaatattcgatctatattcaatatcgttaccaaccgcaataatatttgcaaacatgtcttttaattgcccggcaatagtgatctccgatacaggatattgaatttcaccattttcaacccaaaatccaaaagctccacgtgaataatcaccggtaataatattaaccccttgtcccattaaatcagtgaccaataaacctgttcccatttcttgtaaaagtgcggttaaattttgtgaatttggcttaaccagccagttatgaattccacctgcatgtcctgtactttgcatacctaattttcgaccgctataacttgtcagcaaataggtttgtaaaataccttgttcgataatttctaaatttttcgtacgaacaccttcactatcaaaaggtgttgaagcaagtttgccaatcaaatgcggtctttcactaatatgaaaccaatcaggtaatatttttttacctagatgatcgagtaaaaaactggaatcacgatataaacttccaccactaatcgccgtcgccaagtgtcctatcaatccggttgccacactattcataaaaataaccggcacttcttgagttggaatttttctcggttgtaaatgagatagtgcttttttggcagaattttcgccaacccaaaccgcactttccaactcttgaatattacgtgcaacagtatattcataatctcgctcaagttgttcattgctgcttgcaatcacagaacaagataaagaataacgacttgataaatagctttgtaacatgccgtggctattaccataaactcgcacaccggtatgcgaattaaatgtggcaccttcactgtttacaatgcgtttatcataatctaaagcggctttctctgtttgcaaagccaatgaaacggcatgatcaacatcaatatcagactcatgataaagtgctaaatccggtgcatcaaatgccattaattccttatcagctaaccctgcacaatcatccggagaggtatatttcgcaatagctaaggcggaatctaccgcactttttattgcggtatggcttaaatctgacgttgaggcatttcctttttgattccccaaataaacggaaatacctaaagcaccatcattgttaaattctacattttcaatttcctgtaaacgagttgaaacggataaaccattgacttttgtaactgcaacttctgctgttgcacctgcttgcgtagcagtttcaattgcatagcttacagcatcttgtaacatttgctcttgttgctttaaaagtgcggtggaattttgttgagttatcattataagcctttttattaaacagaaattttggctattttagcttattttcaaatttgtcgctaaccacaaatactatgtcatttcggcaaaatgtgaagttatgctaaaatacgccgaattttacataaggaaaataggaataaatcatggcgaaacgtaaagaagaagtgtttaattgggaagatgaggaacaagaagaaattatttgggtgagcaaaagtgaaataaaacgtgatgcggaagctttgaaaaaattaggtgaaaaactcgtcaatttaaccaaaacaaatttggataaaataccattagacacagggttgcgtgatgcggtcgaacttgcacaacgtttgcaaaaagaagctcttcgccgtcaaattcaatatattggcaaactcttgcgagccattgatccggaaccaatccaagaagcgttaaataaaattgaaaataaacatcagcagcaacaagcaatattacataaattagaattattacgagatgaattggttcaaaaaggtaacagtgcatttacagagctattaatacagtatcctcatgcagatcgccaacatttacataacctaattcgttcagcacaaaaagagcgggaacaaaacaaaccacctaaatcataccgagaaattttccaatatttgaaagatctgattttggaagattaacatgaaaatccgcatgttaaagtgcattaacgtttatctgctatttttcacatgtaccaaaatccgctataatggcggacatttttgatataacgtacctaataatgtaaaaaaaccaaagaggtttattatgactactccagtagttgctttagtcggtcgcccaaacgtaggtaaatcgactttatttaatcgtctaacacgtactcgtgatgctttagtggctgattttcccggtcttactcgggatcgaaaatatggtcaagcacatttcaatggttatgactttattgtgattgatacgggaggtattgatgggacggaagaaggcgtagaggaaaaaatggcggagcaatccttacttgccattgaagaagccgatattgttttatttcttgtagatgctcgtgccggcttaacttctgcggatgttggtattgctcaatatttgcgtaaacgccaaaataaaactactgtacttgtggcaaataaaaccgatggtattgatgcagattctcattgtgcagagttttatcaactgggcttgggtgaaattgaaaaaattgcagcatcacaaggacgcggtataagtgcattaatggaaaaagttttgccgtctgttgccgacaagctaagtttagctaacgcagaagatcattcagaaagtgcggtagaaaattcagatgaaagtgcggaagaatgggaaaaagattttaattttaatagtgaagaagatatacagctacttgatgaggctcttgtagaagaacaagaagaaagtgaagataaaaatatcaaaattgccattgtgggtcgtccaaatgtaggaaaatcaacactaactaaccgcattttaggtgaagatcgtgtagtggtgtatgacttaccggggaccactcgagacagcatttatattccgatggagcgagatggtcagcaatacactctcattgatacggccggtgtacgcaaacgtggtaaagttcatttaacagtagaaaaattctctgttatcaaaacattacaagctattcaagatgcgaatgttattttgttgacgattgatgctcgtcaaggcatatccgatcaagatttatcgttattaggtttcattttaaataccggtcgttccttggtcattgttgtcaataaatgggacggtttaaatcaagatataaaagatcaagtcaagtctgaattggatcgtcgtttagactttattgattttgcacgtgttcattttatttctgctctacatggtagtggtgtaggcaatttatttgacagtataaaagaggcttatgcttgtgctacaaaaaaaatgacaacgtcattactaacccgcattctacaaatggcaacagatgaacatcaaccgccaatgataggtggacgcagaattaaactaaagtatgcacatccaggcgggtataatccaccaattattgttgtacacggcaatcaaatcgaaggtttgccggacagctacaaacgatatttatctaactattaccgtcgtagcttaaaaattattgggtcaccgattcgtttattgttccaagaaggaaacaacccgttcgcagggcgtcgtaataaactgacaccaaatcagttgcgtaaacgtaaacgtttgatgaaatttatcaaaaaatcaaaacagcgataaatataatataaatgggcggaaaatatccgcccaaaatcactgcactttgcctctatattttttcttattttgcgatctctctcgcaaatatttcccaattcaataaactttcaactttttatcttttatattaaagccttcccacacaaacggatataaggataattatgcgagtatcagcactattttttatgttgttcattataaaagttcaagcaacattgccggatttcatgctgttggaaaactataaaaatcaggacgtaagcggttgggtgatgagtgaaaagttggatggcattaggggatattgggatggcaaacaacttttcactcgacaaaataaagtcattcagccaccgcactattttattcgtgatttcccaccctttgctattgacggcgaactttttaccgaacgtaatcaattcgaaaaaatatcctctattgtacgttccaaaaaagataaaggttgggaaaaaatgaaattatatgtttttgatgttcccaatgcacaaggaaatttatttgaaagactggctgttttacaagattatcttgataaacatcctacaccttatattcaaattattgagcaaattcccattaaaactaaacaacaagtgaaaaattttttacaacaaattgaaaaacagcaaggtgagggagttgttttacgtaatcctcatgctacctatgaacgaaaacgcagtacacaaattttgaaattaaagaccgcacttgatgaagaatgtactgttatagctcatcatcaaggtaaaggacaatttgaaaatatgctaggctcaatcagctgtcaaaatcatcgtggcatttttaaaatcggctcaggatttaatttaattgaacgtagaaatccacctccaataggctctattattacctataaatatcgtggattaactaaaaatggacttcctcgatttgccacttattggcgttcaaagaaagaataaaagtgcggtgatgattgatataaaatcttcttatggggctgatattttcctttacaagccgtaaaatctgcctaaaataaagcccccaaatagcttgcatggtcaagctactgacttgtaatcagacttaagagaaaatttatgacaactcaattcaaaccggaattattatctccagccggttcgttaaaaaatatgcgttatgcttttgcttatggtgcagatgccgtatatgccggtcaacctcgatatagcttgcgagttcgcaacaatgaatttaatcatgctaatttaaaaatcggtattgatgaagcacatgcacttggtaaaaaattctatgttgtagtgaatattgcaccacataattctaaattaaaaacctttatcaaagatttacaacccgtgattgatatgcaacctgatgcactaatcatgtcagaccccggcttgattatgttggttcgtgagcatttcccaaatattgatattcatctttctgtacaagcaaatgcagtgaattgggcgacagtgaaattctggaaacaattgggtttaactcgagtgattctatctcgtgaactctccttggaagaaattgctgaaattcgccagcaagtaccggatattgaagttgaaatatttgtgcatggtgctttatgtatggcatattcaggacgctgtttattatcaggctatattaacaagcgtgatcccaatcaaggtacttgtaccaatgcctgtcgctgggaatattctgttgtagaaggaaaaacagatgaagtaggcaacattgtgaatgttggtgaagaaattcccgttaaaaatgtcgcaccgacgttaggtgaaggaaatacaacaaataaagtctttttattagcggaaaatcagcgacctgaagagcaaatgtcagcctttgaagatgagcatggtacttatattatgaactctaaagatctacgtgcagtgcaacatgtagaaaaactttcacaaattggtgttcattctttaaaaattgaagggcgtacaaaatctttctattattgtgcaaggacggctcaagtttatcgcaaggctattgatgacgcagtagcaggcagaccttttgatgaaagtttaatggatacattggaaagtttggcacatcgtggctataccgaaggttttttacgccgtcatacgcatgatgaataccaaaattatgattacgggtattctatttctgaacgccaacaatttgtcggcgaatttaccggtaaacgtaatgaaaaaggtatggcggaagttgcggttaaaaataaattcttgttaggtgatgaagttgaattaatgacgcccaaaggcaatgtggtttttaccattgagcgtatgcttaatcgtaaaaatgaacacattgatgccgcacttggtgatgggcattttgtttttttagatgttcctcaagacattcaacttgattatgcgttactcatgcgtaatttagttaatgcaaatacaagaaatccgcataataaaaaataatcgtttgttagaaattttttgtgaatgtaaaaaatatttcgccctttcttgatgaaagggcttttttaccctctgtttatatcacctaatttatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttatttgaaaaacctttaaaaataaccacttttatttgccaaagcaccattgggacatttattaaatcaatctggcgtgattttttgtcaagaaaaaattgcttttgatcacgtaaaaagcggaaccattaatgatagcaattattttgtttattatggcaaagtagcatcattggaacaacattttcaattgcaaggcaaaaattatacttgctacgctttttctaatcctccttacccttttgttagaccagcaatttttgmtgatgaactcaattttttagagcaagcactctcaaataaaaacaaaattgataaaaagaaagcttttgtattttttaaacgttatgccaatcaaccgatttgtgttggaaacctccttcaaaaaccatcctatctcctctattttcgttggggcagtcataacattattggcaacttttattttttctgcactggcatggctcattagttccattattgtcttctggcagcaacgcaaaattccctctgagtatcgacaaaaaatgcgtaaccgagaaccatttcaacgcttatcgaaaattgtgccacttgttttttaggtgcgggtatttatggtgcggtcgccactcacgatattctgtcaaaatggaacggatttccacaacctcagatccaacaacttgctacgcagtattgctcagccaattggtgccaaaatctttccaaaatcaacatcaaaacaaggacgctacccgctggagtttatagtgcggaagaaaaaacgcgtattattcaaaaaaccttagtcaaaaaaggttacaaacttaaagtggacggaaaatttggtacaaaaactcgcaatgccgcagtaagttaccttgcgaccaaaggtatcagcgtcactaacgatatcgccttggatcggttgtttgagtattttgaaccaaacttacagtaaaaaaaattattttgaagtactgtatattgatagaatgtttattctaatatatagctttttatatgacttaaactctttttaacgtgcctatttctttgctttaattacagatgttcttgtatattatagtttttcatatctgtgatatttatcacaaaaacgaaataaaaattccaaattttaataaaaatgaaaattttgcattgaaataaaagtagcaatattgtattaatatcaaggtatttaagtggttcaatattacagtctgatcactaaatagagaagttcattgctaaatttaatatttacatatgctaaaattgataggaaaattctatgaaaactgcaaaaaactgcaaaaaactgcaaaaaactgcaaaaaactgcaaaaaactgcaaaaaactgcaaaaaactgcaaaaaactgcaaaaaactgcatagcattcttttaactacgctacttatctcccttcctgtactatcacaagctaaaaccctaagattggctcatcatatggctaatgataatgttaaccatacactagttatagatttttcagacaaactcaaagaaatatctaatggaaaacttactgttgatgtttactcaaacgggattttaggcgatcaagtggagctatttgaaggaatgaagctcggtactgttgatatgtccatctcagatactagcatcattgcatcttattattctccaattgggattttagatatgccttatttttttaaggatatggagcatattaaaaaattactaagtacagccaaaatggcagaaattaaaaaacaagttgaagccaaatcaggggctaaaatattaagtattcaacctgttgcttatagaaatattattctcaaaaaagaacttgctgataataataaatttgatggcttaaaaattcgagtaccaaattctcctgtacttgttaatactataacgttgcttggagctacaccaagtccaattccatcaggtgaggcatacactgctatccaaacaggagttgtggatggtatggaaggtaatccggaatttttaagctccattaaaatcagcgaagtagctaaaaactggtatgagacacaacatgccatgacttttactgcgttaaatattagtgctaaaaaatttaattcattaacagaatctgaacaacaatggatcaaagaggctgtaacttttgcaatagatcagttttatattaagactgtcaacactgatgaaaaatggagaagttatctaaaacaacaaggtgtcgagtttcataatgtagatataccaactctaagagaaaaagctaaaccaatggttgataaatttgttcaggcaaacggattagaagaattatataaagaggcacaaaaatgaaactagatggttatatttcctcattcagaaatacattaacgattatacttttttctgcacttgtcattgttgtatctataggtgtgttttctagatttttaacatcacatcctttcgcttggactgaagaactgtctagatttatttttatttggttagcttggatagcttcaagtttaacaattgctaagggcattaatattacctttgatattgtgctggataaattagaacaaaccgttggtaatattgctcatattattgtgaatgttatttctatcatttacatactcgcagtcattatattgggatatatactttgtattaataatacaaattcatactcccctttactaggtgttccaatgtggactctaaatcttgcgatacctgttggtggggtattgatggtttatgagcaaattaaaaatttaatcaagaaacgttaattataatgaggtgatatatgctacttcttgcattcttatgcttctttattttggttctgctcggtgtgcctattgcattttcaatgggattaggtgccataatttcaattctgtctaatgatttaccgttagcattgatttctcagcgtttattctcaggtataaattccttttcattattagcaattccgttttttatgttagctggagaattaatggagaatggaggaatatccagaagacttattcatttatcgaaatgtttagtcggacattttagaggcggtctaggtatgatagatatatccacctctgtaatttttgccggagtatcaggatctgcagcagcagatacagccgccgtcggttcaattatgatacctaccatgaaaaaaaatggctatccagcaggcttaactgcagtccttcaatctgtagcaggatctcttggtccaattattccacctagcttaactgcgattatttttgcctcattaactggattatcaattaaagatttatttttagcagggattttacctggaattgctatagctatcggattggttctagtcacctatttctatgctaaaaaatataatcttggtagagatcaaaaggcatctagagccattttatgcaaagcatttaaagaggcgtcttctgcattatttatgccggttatcatagtaggtggaattttggttgggttctttacgccaactgaagctggggctgtagcagtactttatgctattgcagtcggtatttattataaagaattaacttttgaaaaattcaaacattcaatactaaatgcagccgcaatgaccgcaatgtgtaccctaattatatcaggagcaactattttatcatggattatcgccttcactcgtttgcctgatttaattatagggttcttaacaagtattacggataatccttacatgatccttctgctcttagtagcatttttattatttatcggcatgtttattgaaactattgccgcaactattattgttgcaccaattttaatgccagtagcttatcaatatggaatagatccgatacaatttgccataattatgatcgttgtcttagtttacgcaggagtaacccctcctgtcggtggagtattgttcattactatggggattgctaatgtcaaactacaggaaacgctaaaatacctcgttccttatctaggtgtcatattcatcgttgtgttactgatgatattatttccttcgatctctttgatgatacctaatatgttccgttaaaaaacaagtgagtataatgtgtttttcattttactcacttgatggcgataatgacacaatttcctcttgtatgaacccatatttgcgactagactacgcccttacagtttttattatgattttacgaagttatgtatttatctgatttctattttgacttacctgatgaattaattgcacgttatcccaaacgtgagcgttcttccagtcgtatgttgcaattaaacggacaaaacggagaattatttcaccgcacttttagcgatgttgcagatctgattaacgaaggcgatttgctgatttttaataatacccgagtgattccggcgagaatgtttgggcgaaaagcaagcggtggaaaaatagaagtgttggttgagcgggtactaaatgaacatcattttttagcccatattcgatcttcaaaatcaccgaaagaaaatacagtgctttttttaggtgaagataagctgggagaagggaagggtgttgaaatgctgatgaaggcacgccatgaaaatttatttgaactggaattaagtgataaaagtaccgctcttttagatattttacagaaaataggtcatatgcctttacccccttatattgatcgtccagatgaagatgccgataaggaacgctatcagacggtctacaataaagttccgggggctgtggctgcaccaactgccggcttacattttgatgatgagctattgacacaactcaaaaacaagggggttaattttgcctttgttaccttacatgtcggtgccggcactttccaacctgttcgtgtagaaaatattgaagatcataaaatgcacgcagaatatgtggaagtcccgcaagaagtggttgatgctgttttagccacaaaagcaaagggtaaacgagttattgcagtaggtacaacttctgtacggtcaattgaaagtgcggcactttttgccgaagaaaataatagcactcatttacttgaaccctatttttccgacacttccatttttatttatccgggcaaaaaatttcgtgttattgactgtttgattaccaatttccatttgccggagagtactttgattatgctggtttctgcttttgccggttatcaacatacgatgaatgcttataaaagtgcggtcgaaaatcgctatcgcttttttagctatggcgatgccatgtttattacgaaggcctaaaagccgattacatcagactgtttatctgacgagaaggattacaaatgacaatgaaatttaccttacataaaactaacggtatggcacgtcgaggtaccatgacttttaatcgtccgcagggcgaatttacggtggaaacgccagcttttatgccggttggaacctatggcacggtaaaaggcatgacacctgaagaagtgcgggcaacaggggcagaaattttactgggaaatacctttcatttgtggcttcgccccggtcaagaaattatgcgtcaacacggtgatttacacgattttatgcaatggcatcgtccaattttaaccgatagtggtggttttcaagtttttagcttaggtaaattgcgtaaaattactgaagaaggtgttaaatttcaaaatccaattaatggcgaaagaattttcttatcaccggaaaaatctatggaaattcaatatgatttaggttcggacatcgtgatgattttcgatgaatgtacaccttatccggcaactttcgattatgccaaaaaatccatggaaatatctttacgttgggcaaagcgtagtcgtgaacgttttgatgaattaggtaataaaaatgccttgttcggtattgtacaaggcagtacttttgaagatttacgtaaactttctattgaggggttaattaatatcggttttgacggctatgctgttggtggattagctgttggagaacctaaagaagacatgcacagaattttagcatatgtttgcccgcaacttccggcggataaacctcgttatttaatgggtgtcggtaaaccggaagatttggttgaaggtgttcgccgtggtattgatatgtttgattgcgttatgccaactcgtaatgctcgtaacggtcatctttttgtcagtaacggtattgtaaaaattcgtaatgcaaaatatcgtaatgacacaacctccctcgatcctgaatgtgattgctatacctgtaaacactataccaaagcttatttatatcatctggataagtgcggtgaaattttgggggcgagattaaataccattcataatcttcactattatcaacgtttaatggctcaaattcgtcaagcgattgaagaagatcgttttgaggattttgttgtagaattttataaaaaaatcggtaaatctgtgcctacacgataagaaagtaataataattgtcggagaaataacctacaaggtcggttattgataaataaagtgcggtgaaataaaaagatattttcacattaaaagaattttatgctattttacgcaagtttttaatgaatgtttaactcacttataaggataaaataatggaagctcaacaaagtagcccactttctatgttatttatttttgccatttttggattgattttctattttatgatctatcgtccacaagcaaaacgtaacaaagcacataagcagttaatgtctgaattagcgaaaggcactgaggtgttaacttcaggtggtattatcggtaaaatcagcaaaatcagtgctgaaaacgattatgtcgttatcgcattaaatgatacgactgaaatcactatcaaacgcgattttatcgtagccgtattgccaaaaggttctttaaaatctatctaaattttcattcattccgcaagggaacaagtctatgttaaatcgttaccctttatggaagaatctaatggtgatcctagtgatcgccattggtgttttatattctcttccaaatctttacggtgaagatccagctgtacaaatctctggaacacgagggcaaaccgctgatataaacgtgcttactaatgtacaaacattattagagcaaaataatttacctatcaaatcaattattttggaaaacggctcaattttagctcgtttcaacaatacagatgatcaacttttagctaaagataaaattattgaacaacttggtaataattattccgttgcacttaaccttgcacccgccacaccaaaatggttaaccaatattggcggtagaccgatgaaatgggggttagacctacggggaggtgttcgtttcttaatggaagtggatatgcacactgcattggataaacgccaagaacaattacaagacagcttacgtaccgaattacgcaaagaaaaatatcaatatatgtccattcgtaatggagaaaattttacaactctcattaccttagctaaaccggaacaactttccgatgtacaacgtttcttgcgtaaacaacatcaaaatctgaatgttaatgccatttctgaaaacacactaagtttagaattatcagagaacgctctaagagaaattcgtgatcatgctattgaacaaaacttaagtattttacgtcgtcgtgtagaagaattgggtgttgctgaacctgttattcagcgtcaaggggctgagcgtattgtagtggaattacccggtgtacaggatacagctcgggcaaaagaaattctaggtgcaacagcaacgttggaattccgtttagtaaatcaaaatgcaaatttagatgtcgctcttaaaggtatggtgccttctgattcggaagtgaaatatgatcgcaatggtagtcctattgtgttatatcgacgagctgtattaggcggtgagcatattactaatgcaagttcaggcatagatcaaaataccggttctcctcaggtttcggttactttagattctgaaggtggtgaaattatgtcacaaactaccaaacttaatctaaagaaaccaatggcaactttatatgtagaatataaagacagtggtaaaaaagacgaacatggtaaaactattttagctaaacatgaagaagttattaatgttgcgacaatccaaggtcgtttcggttcacaattccaaattaccggcatcaatagccctgctgaagcacaaaacctatcggtattactacgttcaggtgctttaactgcaccaattcaaattattgaagagagaacggtaggcccatctttgggggctcaaaacgttgaacaagggctgaaagcaggattatggggattagccattacgattatatttattctattttactataagctcttcggtttatttgccggcatagcccttattgccaatatgatacttcttgtaggtataatgtctttattacccggagcgactttaacaatgccgggtatcgcagggattgttttatctgtcggtatgtctgttgatgctaatgtattgatttttgaacgaataaaagaagaaattaataatggtcgcacaattcagcaagctattaatgaaggttatagcggtgcatttacgagtatttttgatgcgaacttaaccactattctaacatcagtcgtattatatgctgtaggtactggaccggttaaagggtttgctattacactctctttaggtgtagcgatttcaatgtttactgccattacaggaactcgttttcttgtaaacttaatctatggtggaaaacgtgttgaaaaattatcaatttaaggcaggtgaatagtgagtttatttacacgcaataaaaaagtgcatgaatataacggggtcattttaccttttaaactaaccccttttatgaaataccgctactggggatatgctttctctatcattgtaactgcggtctgttttttctttatttttactaaaggattcaactggggactggattttaccggtggaacagtgatcgatacccatttttctcaaccggcagacctcaataaagtacgatctacattaaaagagaatggaatagaaagtgcgttggtacaaactacgggaggtgttcgagatgtcatgatcagattacctgtcgtagaaagtagtgctgaagtgggtaataaaattaaaactatcctcaatagtttggatgaaggtcttgaaattcatagtattgaatttgtaggtccgaatgttggtgaagaattaacacaaggtgcaatttacgcaacattagcaacattactgatgttattaggttatattgctttccgtttcgaatggcgtttaggtacaggtgcagttattgcccttgctcatgatgttattgtcactttaggtgttttttcctacttccaaattgaaatggatcttactttcgtggctgctatcctgtctgttgtaggatattcgcttaatgatagtatcgttgtttttgaccgagtgcgagaaaatttccgtaaaattcgccgtattgatactgttgaaattattgatatttcattaacccaaactctggcaaggacattaatgacatcaatcacaacattatttgtcgtaattgcactttttgctttcggtggaccaacaatccatagcttttcacttgcgttgttaatagggattgcttttggtacttattcaacgatttatattgcaattactctagctcttgatttagggctaaaacgtgaacatatgctaatccaaattgttgaaaaggaagagtttgaagaaggcttctaaactcatgttgtcgggcatttgcccgacatttagaaccaacaaatcaaaacactggaaactgtttaaaaaaataacaatgaaaaatgagtggtaggatttttcacaacaagagttgtttaacacgagtttttttggttcaaaacgttagtcatgtttttcttatgttattctcatcaaaaacctatctgtatcatcttaaggtcgaataaatcgaataagcaagcatagtaatcggtcaaaaagtgcctactgtcttgctttgaaaaaaaagattgtctttcttaatataacgtattgctatgtatagactctactacacgtttttttggtagatggtatgtattttaggcgtgaaaatttttagaagtatttggaggtaattctaaaatcttagttttgtagagcaaacggaaaagacagaattattgaaattttaagtagcgattttggggattaacgaggtaactttttggtgctctgagcgagacttgaactcgcacgtcctatggacactaccccctcaagatagcgtgtctaccaattccaccaccagagcgtaatttgaatttaggtttttattgaggaatgtcgctgttttttgtgtcaggtgtcggtatgctttgttgtttttcctgaacttgctccgcaacttttgataaatcatcaaacttaccacttttaacattattgctatgtgaattgatattaccaatcaataaactgatagcaaaaaatgctgttgccaaaatggctgtcgtacgagataagaaattgcctgcacctgctgaaccaaaaactgttcctgaagcaccaccgccaaacgaagcccctgcattagcacctttaccttgttggattaagatgaaaccaatgaggacaatggcaataactaagtaagcgatcagtaaaacttggtacattatttcttctctctaaattcaaacatttctataaacaaaataacgtgcgaatactatctaatattggaaaccttcgcaagtggttttgataaaaattcggttaattgttttaatttcaggcaaaatttaaactgtgtttactcattttttttcaaatctgcttttttattctctttcgtttgaagtcctagtttccgcagtgcggaaaaattaaagtaacctaataattcaggtaaaagttcactgagcgtttgcataaattgttgataggatccttgcctgcggctgatgctgtccagttgagcttcccaatgtgcggtcatatccggctgagttgcgatttctggtaaggcttgaatgagtgttctgcctgtttctgtactgtgaatattccgcccttttttatagatgaatcctcgcttaaataataattcaataatgcctgctcttgttgcttccgtacctagaccatctgtttcacgtaagatttttttcaattctttattttgtacaaaacgtgcgattcccgtcattgccgaaagtaaggttgcatcggtaaaaggttttggcggttgtgtttttttgctaattacatcacctttttcacaaaataattcatcaccttttttcacaataggaagcaaaggttcttgttgttcatcttcatcctcttttccccaaagttgtttccagcccgcaatttgtaaatttctcgcttgagcaataaaagttcccccagcaatatttaatgtaattttactttttcgatattcagcctcttgacaaaattgcatcaagtattggcgggcaattaaattatatatttgttgttcattttggtttaaatgcactgtttgacgttttgctgttggaataatagcatgatgtgcttctacttttttatcgttccaacaacgatttttcagctcagtattaactatatcgggaatttctttatataaaatactgtgtgcggaaattgcacgtaaaatggtatgtcgtgcggcaaaatgttcttcaggtagatatcgacagtcggaacggggataagtgatcaatttgtgagtttcatataatttttgacaaatatctaaaacctcttgtgcagacatggcataacgtttcgccgcatctatttgtaatgcagaaagtgaataaggcaaaggtgcggtctctttttctcttttgtcaatatattctgtcaccgtcgccggttgtgcggtaatgcgttttactacatttttagctaaagcgttggataacacccgtccttcttcatcttgataatcttcacaggctttactcggttgccaaagtgcggtaaatgttgagggcgttttttcttttgttgcaataaaggcttgaacctcaaaaaaatctttcggttgaaaatgctcaatttctaaatcacgacgtacaattaatcctaagacaggtgtctgcactcggccaacggatagaacaccgttatagcctgattgacgaccacgaatagtgtaggctcgggtcatattaatgccatataaccaatctgctcttgaacgtgctaatgctgatgtagcaagggggataaaatttttgttaggctgtaatttttttattgccttttctaccgcacttggattgagatcgttaattagacaacgttgaatttcggctaattttgtagcaggcaacttggcataactgaaaacttcatcaactaataattgcccttctcgatccggatccccagcattaattataatgtctgcttgatgaattaatttaagtacaatgtccagctgactttttacttcttgtctgggaagtaatagccatttttgcggaataataggtaaatgttctaaacgccattgtttgaacattggattgtaaacatcaggagcagcttgttccaataaatgtcctacacaccaagttacataatcttgttcgccacatttgacaaagccttgtccacgttgatgcggtttaggcaatacgtcagcaatagctcgagcaaggctgggtttttccgctataaataatcgcattagactactgattctagggattgatgaaagccaaatattctaacataaagtcaggctattccaaattcgctaaattttcgctaaaatgccttgcgttttttgattaacttagatggaagaaaattatgttcggaaaaggtggcttaggtaacttgatgaagcaagctcagcaaatgcaagagcggatgcaaaaaatgcaagaagaaattgcacaattagaagtaacaggcgaagccggagcgggtttaattaaggttacaatcaatggtgctcataactgtcgtcgtattgatattgatccttctttaatggaagacgataaagaaatgttagaagatcttattgcagcggcatttaacgatgcagtacgccgtgcagaagaaatgcaaaaagaaaaaatggcatccgttactgccggtatgtctttacctccgggatttaaaatgccgttttaaattaattcatatatgaccgggacgcaatgtttgcgtccgtttttttaataagataattcattatgcaaagcagtcctcttttagaaaatctgattgaacatttacgctgtttacccggcgttggtcctaaatccgcacagcgtatggcatatcatttattgcaacgtgatcgtagcggtggtatgaatttagctggtgctttaaccgaagcgatgtcgaaaattggtcattgtactcattgccgcacttttacggaagaagagagttgtgcaatttgtaataatccaagacgacaaaattcgggttttctttgtgttgtggaacagccttccgatattccggctattgagcaaacagggcaattttccgggcgatattttgtgttaatgggacatttatctcctttagatgggattggtccgaaagaaatcggtttggatttattgcaaaagcggttacaacatgaaagtttttatgaagttatcttagcaaccaatccaaccgttgaaggtgaggcaacagcgaattatattgcggaaatgtgttttcaacataatataaaggtcagccgtattgctcatggtatccctgtaggaggggaattggaaacagttgacggcacaactttaagtcattcacttattgggcgtcgtgaaattcaactataacatggttgacgtcttcccccgactttaggtggggaggatgtcaatccttattttattgttacacgtgcgaattttcgttttccgacttgataaactgcggtggaaggtgaaacaataagttttgcattgtcgactttttcaccattaattttgaccccaccttgctgcaccatacgaatagcctcagaagttgagccaacaagtccagcatcttttaataaattcgctaaaccgatttcgccggtaaaggtaaattccggcatgtcatcaggtattgcccctttttgaaaacgatcaataaattcttgttctgcagtatctgcatcatcagcactgtgaaagcgtgtaataatttcttttgcaagtaagattttgacatcacgtggattacgaccgttttcaacatccttttttaattgtgtaatttctgtgagcgggcggaatgacaacaggttataccaatcccacataagctcatcggaaattgacatgattttaccaaacatattacttggtgtttcggttacgccaatatagttaccgagagatttagacatttttttctcaccgtccaatccgactaataaaggcatagtaattgcaacttgaggtttttgtccgcaagatttttgtagctcacgccccattaataaattgaaggtttgatctgtaccgcctaactcgacatcggcttctaaatgtacggaatcatgaccttgtaaaaggggataaataaattcatgaatggcaatcggttgattattgttaaatcgttttttaaaatcatcacgttccaacattcttgcaacagtataattcgatgccaaacggatcattcctattgtacccaacttacctaaccaatctgaattgaatacaacttgtgttttttgtggatccaatattttgaaaatttgtgttttataagtttccgcattgcgtaacacatcttctcttgataaagggggacgagtagtattttttcctgaaggatcgcctactgttgcggtaaaatcgccgattagaaagattacttcatgaccaaagttctggaattggcgaagtttattaagtacaaccgtatgccctagatgaatatcgggtgccgttggatctgcacctaatttaatgcgtagcggacggttttctttgagtttttcaatgaaatcctgttctgaaaaaacatgatcaacaccacgtttcaattcggcaattacagtatttatattagtcattatgaatccttaatttgaataatattaataagttttttattttccttattatagggattattgattaaaagaaaagtccatagaatataaggttgtcgtaataattcatttttttctcggcgaccaaagtgcgaataaaaaaagcggtcaaaaagtatttccttttgaccacttatcttctattttaaagactagaatttataatttacacccaagcggaattcatgaccacgtgctggaagcgtgttatcatttccacgttgtgcatgcgatttgtaatgcttgttcataatattatcaattgcaaagttgacattcatgctgtcatcgttaaacggtttccagttgattgtcaggtcagttacattataaccaggtttgcctttacccggcgtaacgttaccccctaccagtaagaagtcgtctttagctttgactttttcaacaaggcggtgatgtaaaccgatttcaatattaggttcctcgaaacggtaacttacagatgccgtccatgtgcgacccatcgcagaagcgtattcaggattgccgcttagtagtggtttgttattttcgatgccgccaccttttttggcttttttgccaagattggtgtagaagcgaggtttgctgtcggcgacaccaagacgagcggtaaagccaccttgatggtaaccgaaattcaattcataaccgcggtttttaattttgccagcatttaagatgctctgccaaccaccatgattcgagtggttgtcgcgaccggcggttgtgcctagggcatctttgatacgttgccagaaatagctaccgtctacactgaacgtaccgttgtcatagttaaacccgatttcagtggtgcgtgcctgctcggctttggtgccttcaagaatactggttaaaccacgattttgaccatgacttaaaatggcatcttgcatacgtgggctacgggtagcgtagttatggctcgcactaaagcttagctcaggggtggcttcgaaaatcacgccgatactcgggttaaaacttgaatcactgacttttttgccgtccatcgctttaaaggtaaactgatcatagcgtaacccggttgttagcgtaagctggtcagtggctgctgttatggcttccacataaaaaccagtatctgatttacgttgattagagatacctccggctttaaagtgcggtttggactcttgatggcggtagttgataccgtatttcacgagtacattgtgatgaaccggtaaatcaaaattgacgtttgctccttgggtcaccactttgatttgagtggcaccttctctattgccggcataaccattgcctttgtcattggcagaccaacgaccatgtactaaacgataaacattgacagtggcttctttggcaaagcctaagtttttccctgtccattctaaattggtgttatcgaccgtcattttgcgtgcagcgggggcttgtttggttggattaaaattgacaaactcttcacgcaccaaacgatcgccttcatgttgttcgtgcaaatggctcaagacaaaacggtgatcgccgacggtagcaccgactttggcgaggtagctgagtttatttaaatcgctgtacaagacacggtcagatttgtttactgaatcataataacctttaccggctttgtaattgccgtctttgacaaagtttgttgcgattaacgcatcaaacatcccgctttttccatatacggtggcattataattttgagagtaattggtgctgaagcctgtgccaactcttgcaccgaagtttttatcactgccttccagtaaatctaaggcatctagggttttggcaacaatcgccccgttggtttgaccgataccagctgaagcactacctgcccctttttggacagacacaattttgaccatggcagggtctagcatatgacgaccttgatggtagtgaatttgtgcatcagaatacgcattgtccactttaacatcaatggagttttgtcccataccacgaatataaaggtattgagaagtgccgttaccccccccctatggcgatagatggctcgtttttcagtaaaccgcgtaaatcggtttccgtactttcgtctttgatttgggtggtcacgacattggttttgacttttaaaccttgatgatttgtaacattgatggtgtccaatmccacagcatctgtttgagcaaatgtatttgcggtaaacacaccaaatactagagcgggaataggcagcaatttaaactttttcatttgatttccttaatataaaaactttagaaacatattctaattcttatattgaaaattattttcaatgataaaaacggcgtgatactaacataatttaattttattgcaaatatttctcattcaaattttcacataaatcaagcgttaactcgttgagcaaggaaatctaatacctgctccttagcaattatttgtttttcacccgtacgacgatttttatattcaatttcgcctttttctaaatttttttcaccaataacaatcatatgaggaacacctatcaattccatatccgcaaacatcactccgggacgctcttttcgatcatcaaagataacatctacatttttattgagtaagctctgatacaattcttcagcaaaaatttgtacattttttgacttatacatattcattgggataattgctacagtgaacggtgcaatttcatcagaagaccaaataattcctttttcatcatggcactgctcaatagtagcagcaacaacacgacttactccgatgccgtagcaacccataatcatcgtttgtgggcgaccatcctcaccttgtacagttgctttcattgcctccgaatattttgtacctaattggaaaatatgcccaacttcaatacctcgcttaatctgtaaagtacctttgccatcaggacttggatcgccttctacaacattacgtaagtctgctactttaggtagggcaacatcacgatcccagttaacattaaagtaatgtttgccatcaatgttcgcaccagtgctgaaatcgctcatgagtgccacggagcgatcaataatagtcggaattggtagattcacaggccctaacgatcctatactggcaccaatttttgtttttatttcgtcttcatttgcaaattctagaggctcggcgacctccggtaatttttgtgctttgacttcgtttaactcatgatctccacgtacaatcaatgcgataagaggttggttttcatttgcaccttttacgatcagtgttttaactgttttttccacagataaattaaattgttcaactaagtcattaatagtttttgcatttggtgtatctactaactctatagttgcactcggtgcctggcgttgacctattgctacggcttccgccaattcaatattggctgcgtagtcggaattgcttgaaaaaacaatatcatcctcgccactttttgccagtacttgaaactcatgagatgcactgcctccaatagatcctgtatcagcttgtacggcacgaaaatctaatcctaaacgagtaaaaatattattgtaagttcgatacatgacatcataggtattttgtaaacattctttgctggtatggaaagaataggcatccttcatcaaaaattcacggccacgcattacgccgaaacgaggtcgcacttcatcacggaattttgtttgaatttgatataagttcaatggtaattgtttataagaactgacttcacgatgcaccaaatcggtaataacttcttcgtgagtaggccccaagacgaaatcacggttgccacgatctacaaaacgtagcagttccggaccatattgctcccagcgttgggactcttgccatagctctgccggttgaacaacaggcatttcaacttcaattgcaccgctcttattcatttcctcacgaacaatattttccacttttttcaaaacacgtaagccggtgggtaaccagttatataagccggatgccaaaggtcgtatcatacctgcccgtaacatcaattgatgacttactacttgagcatcatttggggtttcttttaatgttgataataaatatttactcgtacgcatttttgttcctatatttcatgatcttgaatgaaaaaattggtaatagtgtaccattgagtactattggaaaaaaagtaaaagggataagaaagtcatattttttagtcaagggaatagttatcctttccggtagcgacgtaatttgcgaagtcatcatgactaaatccatgagaaagcatataacgccaaattttttgtttagccctagaatctaatttatcacgatagtaaggaaattttttatttaaaacctgtaatactatttcgttccaatcaatttcactttcttgctcaatttcgttaattagttctgctggaatgccttttagctgatacaattcctgtctaattcgctgtaaaccataaccacgttttgcacggtaataaaggtaattttcagcaaaacgtttatcattttgccagtttttttgttgacagtgggtaagtgtttgagtaatttcttgctcagtaaaacgtttctcctgcattttgcaacgaagttcaaattcactatattcacgccgagcaagtaaactcatcacgtagcctaatgcgagagaagacatatatttattttcctttgcggttaaatgtagataaagagagtatggacgaaagaaaatgcggtcgttttaccgcactttctatgatgagagctaaactctccgtgttaattaaaaatcactttccgttccggatatatttgattctgattcagcttcaatatctgctaatagtgctttttccggatttgccaataattctgaacgtaatttttgctccaaaacagcagcttgatcaggattttcagctaaccatttcattgcatttgctttaccttgaccaattttttcgccctcataagagaaccaagcacctgatttatttaccaacttgtgttttacacccaattcaataagctcaccatttctagaaataccttcaccgtataaaatttggaagtccacttgtcggaacggaggtgctactttatttttaaccacttttacacgagtttcattaccaatgacttcatcgccatttttgatactaccaacacgacgaatatcaaggcgaacagaagcatagaattttaaagcattaccacctgtcgtagtttcaggattgccaaaaacgacaccaattttcatgcgaatttggttgataaagacgaccaaacaatttgagtttttgatctgacctgttaatttacgtaatgcttgcgacataagtcttgcctgcaaaccaacatgagtatcacccatttcgccttcaatttctgctttaggcgttaaagcggcaacagagtcaacaataaccacatctacagcaccggaacgaactaaggcatcacagatttccagtgcctgttcaccattgtcaggttgagaaattaataattctttaacatcaacacctaatttagcagcataaatcggatcaagggcgtgttccgcatcaataaatgcacaggttttccccgctttttgtgcttgagcgatgacagataatgttaaagtagttttacctgaagattcaggaccaaaaatttcaacaatacgtcccattggtaagccaccaatacctagagcaacatctaaactaagtgaaccggttgaaattgcctcgatatccagtttttgggtgtctcctaatttcataatcgcacctttaccaaattgtttctcaatttgccctagagcggcttcaagtgcttttgctttttcttctggggttgccattttatacctcaagtaaattatgtatcagaatttatgtacaatattatactgtattcacatacagtgcaatttaaaatttgatatttttagaaattttgcgatctaatcagcaaaaagagaaaattattccgtattattaattaaattttctaattcttcttgcatggaaaaccatgaaacttcaacatcttcaagtgcttttttaagctgaacctgttcatttaaaagtgcggtgagttttgttttattttctgtttgataaagcactgtatcagaaagcagcatttcaatttcttgtagtttttgttgatatatttgcattttgcgttcaatatcggcaatttcttttcgtaatggtgcactccgttgacgcagttcagcttcttttcttttttgttctttgcgatgattactggtgttttcgttattattgatgattttttcgttgtgcttcggcgtgctattaatttcatttagccatttttgatagtcttctaaatcgcctgtaaattcctcaacttgtttattatgaaccaaataaaattcttctaccgtattacgcagtaaatggcgatcgtgggaaaccacgattaatgaaccttgataatctattaatgcttctgtcaaggcttgacgcatgtctaaatctaaatggttggtcggttcgtccaacaggagtaaatttggacgttgccaaacaataattgctagaaccaagcgggctttttcaccgccggaaaaagaagaaacggcttgatttactttgtcgccatggaacgcaaaactgcccaagtaatcacgtaattgttgttctgtttgttggggagcaattttttgcatatgccagagtgcgttttcttccgaacgtagcgtatccaattgatgctgtgcaaaataccctaattgtacgccttttgctaattggatgtggccggaaagtgcggtcaattctcctgccaataatttaattaacgtagatttgcccgcaccatttttaccgagcaacccgatacgagatcctggtactaaattgagcttaattttttgtaaaatttccaccgtactttctccattgtcataacctgcactggctttttcaatggaaaccaagggattgggtaaagcgagcggttcacgaaatttaaaggtaaaaggattatctacataagcaggtgcaataagttccattcgttctaaggctttgactcgactttgtgcttgtttggctttagttgctttggctttaaagcgatcgatatatttttgtagatggtttattttttgttgctgttggcgataaagtgcggtttgttgtgctaattttgttgcacgttgcacttcaaaggaagaataattgccactgtattcatgcagtttatgttgttcaatatgaatgatcttattcacaataggatcaagaaaatcacggtcatgtgaaattaaaatcaaggtgccttgatattgaattaaccaacgttctaaccaaatgacagcatctaagtctaaatggtttgtcggttcgtctaataagagtaaatcagagcgacaaagcagggcttgtgcaaggttaagacgcatacgccaaccgcccgagaaagatttaaccgttcttgttaaatcctcttgagaaaaccccaatccatgtaaaagagaagccgctctcgcttgaattgtccaagcatcaattgtgtctaattgtgcatgaatacgggcaatatcattgccatgattattttcggtagcagttgctaaggccttttgtaatttgcaatattcacgatcgcctttgataacataatctaacgcacttatttctaaggcgggtgtttcttgatttacccaagccattgcccagtgatttggaaaagttatatcaccttcttcagcactcatttcttttttgagtagtgcaaataaagaagatttaccacaaccgttttttccgactaagccaactttttgaccggggttaatagtggcacaggtattttctaagagtaaggtatttccacgttttaaagttaaatttgtaaaaaggatcattagataaactcactattgattaataccgatatctccactcataaatcggaacataattagaggtgaaacctgatgagttgagcaaaggtgaagatcgtacacataacttgcaacgcttagatcgatcaaccgcaacattgtctttagtctagtcgtaacgatctaaaaacgattgtttatactcgagttagtcgttacgatcggaaagatgattggattcgtaaagttcgaagtggaaaactttacaaaatatccaataattccacttcaaataccaacgtgctgaacggtggaattgatgcaccggcaccacgttcaccataagccaaatgatgtggaatagttaatttccattttgaacctagcggcatcatagataatgcttcaatccaacctgcaattacgccacttactggaaattcggctggttgcccacgtttgactgaactatcaaatacagtgccatcaattaaagtccctgtataatggacacgaacttgatcttgacgagttggaattgccccactgccttctaccaacacttcatattgcaaaccagagtctgttacttttacactgtcttttttcgcattttcttcaaggtattttttaccttcttcttcaatttgcttaaattgtgcttgtgcaatttcgctggcttgttgctgtaattcctgtaacgctttagcaacttcgtttaattctaaagcgggcggattttgattcaatgcgtcataaatcccttttgcaacggcttcagctttaaccgctaatttgctatcgactaattgttgaccgatttgtaaaccgataccataactaccttgagctgaaacatcatctaaggcaacctgtgcaaaaaattgttttgtcattgttttccctttattgtcgttgaaaattatttcttataagccaatacttcgcctacacgtacaggcacaccaacgtccaaatggtttgccagttctaccttatccgcttggaatagattgatcactgttgaacctaactggaatgcccccatttcttgtcctttacgtaattgcaccgcactttcaccgctataagtccactctttcacttcagcactgcgtggtggattaattattccagcccaaacagtactcatactggcggtaatagtcgcaccgactaaaatctgcaccatagtgccgaattccgtatcaaaaacacagatcacacgctcattacgagctaataaattaggaatatgttcatttaaaaacggattgaccgaaaataaatcgcctggcacatacatcattttacgtaaagtagcatcgcaaggcatatgcactcgatgataatctcgaggagaaagatagattgtagcaaattcaccatgttcaaattctttagctaattcagtatcgccagccagcagatccactaagctaaaactatgtccttttgcctgcaacaaagtttgttgctcaatatgtccacattgactaattcgcccgtccgcaggtaaacaaagtgcggtaggattttcatcaatttttctcgcatcagcttttaacggacgaataaaaaattcattaaaacttgcatagtccttaaattctgttttctccgcctcttgcatatttacatgatattttttagcaaaaagtttaataataaaatgcgttacacttccccatttttgttttgccagccagccagctgcaagagttaaataaagttgtggcatgacatattgaaaagcaattttcaaacgttgccaataagtcggttgttttttttcagcattatacataacaggtttccttgtaaaaattggacgaggattataacaagttattggtgtaatgtaaccagcagaagagttattgtttgtcgtagaggggcggttttaatctaaagttaataaatagacgttaattatgaattggttaagtcaagcctattattggtgtataatggattttaataagcagagagggagatataatatgtgtacgattatgcagaaagaagtgaatttctggcagtaattgagcgtttaattaaatggaaactcaaagattaataacatagataagagaatcaattatgcatatcctgttgcaaaaatattataattatttacgcattgaacgacaactcagtccatatactctcataaattatcagcgtcaattggaaaaaattgtagcgattttacaacaaaacgatattcaatcttggcagcaagtaacaccaagtgttgttcgttttgtattagcacaaagtcgcaaagaaggattacatgaaagaagtttagcgttgcgtttatctgctttacgacaatttctaaattatttggttgtacaaggtgaattaaaagttaattcagccgttggtatttctgcacctaagcaaagtaaatatttaccgaaaaatatggatatggaacaggtgcaacaattattgactaatgaaagcaaagaacccatcgatcttcgtgataaagcgatgatggagttgatgtacagttcaggtttgcgtttatcagaattacaaagtttgaatttgaatagtattaatattcgctctcgtgaagtgcgtgtcatcgggaaaggaaataaagagcggattttaccctttggacgttatgcttctcaagctatccaacaatggctgaaagtgcggttgttatttaatccgaaagatgaggcgttgtttgtcagtcaattaggcaatcgtatttctcatcgttccattcaaaaacgtatggaaacttggggtattcgacaaggcttgaatgggcatctcaacccacataaattacgccattcttttgctacccatatgctggaaaacagctcggatctacgtgcggtacaagaattattagggcatagtaatttatccacaacccagatttatacccacttggattttcaacacttggcacaagtttacgacaaagcacaccctcgagccaaacgtaaaaaatagttggaagcaggcaaattcaaacgaaatattaccgcacttgatggacgttcaagcacaatttgacaggttaccttgctcaacaacaatgccaacattattagcttgtgctatcgctttaggtttacttaattttatttttacccaagaaatattaaattttactcttaattgctctgcaacttcgtaagctactcgctcaattaacaaaaatgggcgagattgaacataattcaatataaactcactcacttccgcataatttaagcaatattttacatcatctgtttgtgcggctcggcgacaatcccacgccatttcaatatcaaaaatgagcttttgcttgatttgctgttcccaatcataaacaccaatttgagcaagtgcggtcaatccttcaataaatattttgtctgtcattataactccgatgaacgaaattccattaggcttatactatcaagtttatgtacaatagacgaacgaaaattttctgttccagcgatagggagttgatgatgagtttgtttgcgattatttatatgttattcacttatttgttagggtcaatttcgagtgatgttgtgatttgtcggtttaccgagcgaaacgatgctcgtgtaacaaactcaaatgtattacaaaaaggggggtatcggcttgttttggcagtttttctatgtgatgtcttaaagggtatgttgccagtttgggtaggctattatttagggttaacttactttgaattaggcatggtagcactcgccgcttgtttaggtcatatttttcctattttctttaaatttagtgggggaaaaggggtggcgaccgcatttggtgctatcgcccccatcgcttggggtgtcgccggctcaatgcttggtacttggcttttaatctttctctttagtggctatgttgcattaagtacggtcgtaactgcattaatattgcctttctatgtatggtggtttaaaccagaatttacttttcccgttgcattagtttgttgtttgttagtttatcgtcatcatgaaaatatccaacgtttatggcgaggacaagaagataaaatttggtctaaatttaaaaagtaacgttacatttgcttgcttaaaaatttaaatagaaatcttgggttaaggttttaaattctgtactgtattgattgttccgatcataaataaccaactgactttcctcacatttccgttcttctcggctaaaactaagtaataaacgctgtggagttttacctgctttagtgatgattttacattctctaatacaaaaaagaccgcactttttttgtaaactttttccttcttcaaatggcaaaatcaagtgaatttcacccgttaggtttaatagtttttcggcggcgtttagccaatccaagtggctttgcgttaaggtatagcgagctagattgcgttgtttactggcacaattaataccttgcttaaaataaggtggattcgccgtaatgacatcaaatttatgctcacaatcttgtgcaaaaacaataatatcttgttgaaaaatcttgattttatttgcccaagggctttgttggatattgtcttttgcttgcaaataagcctgcggatccaattcaactgcactaatgtgacaatgttcagggctacgttgagccaacatcaacgcaatgagtcctgtacctgtacctaaatcaagcaacgtatttgcttgatttatatttgcccatgcacccaataaaatcccatcagtccccactttcattgcacattgatcttgattaatgtgaaattgtttaaacgtaaactcttgcttttttgccataaatatcctgaaaaatgaccgcactttaagaacaaagtgcggtataatttgccacaaattttttttgaataccaattctttaatgtggataaatatgacatcaacgcaatttgaagacttcgatcttgcccctcaattactaaaagcccttgcccaaaaaggctattctcgacccacagtcattcaacttgatgctattcctgccatcatggaagcgagagatgttttaggttctgcaccgacagggacaggaaaaacagcggcatttttgttacctgctcttcagcatttgttagattatccacgtcgtaaacccggccctcctcgaattttagttcttacgccaacacgtgagctggctatgcaagttgctgaacaagcggaagagttggctcaatttactcatttaagtattgcgacgattactggtggtgtggcttatcaaaatcatggtgaagtgtttaataaaaaccaagatattgttgttgctacaccgggacgcttactgcaatatattaaagaagaaaactttgattgtagagccgttgaaatactcatttttgacgaggcggatcgtatgttgcaaatggggtttggtcaatatgcagaagaaattgcggcagaaactcgttggcgtcggcaaaccttgttgttttccgctacgcttgaaggtgagttattaatggattttgcctctcgcttactgaaagatccggtgcaatttaatgcggagccaagtcgtcgtgaacgtaaaaaaattaatcaatggtattatcatgcagatagcaatgaacataaaattaaactccttgcacgttttattgaaaatgaacaagtaagtcgtggtattgtatttgttcgtcgtcgtgaaaacgtgcgtgaattgtctgaaattttacgcaaacgtggtattcgcagcacttatctagaaggtgaaatggcacaaactcagcgtactaaggctattgataaactgaaaaatgatgtggttactgtgttagttgctaccgatgttgcagctcgtggcattgatattgatgatgtcagtcatgtcatgaattttgatttaccttataacgccgatacttatttgcatcgtgtcggacgtaccgcaagagcaggcaaaaaaggtaccgcagtatcttttgttgaagcacatgactataaattattaggtaaaataaaacgttatacaggagagttgctaaaacctcgaattatagaaggattagagccaagaactaatccacccaaagatggtgagataaaaacggtgagtaaaaagcaaaagaaccgagccaaaactaagttggaagagaataaaaaagcagtgcagaagaaaaaacaaaaacttcgccataaagacataaaaaacattggcaaacgtcgtaagccaagtgcaaaagtcgctgaataaaccaacgatatatccccttgaattaaggggattatgttattgatagctcaaaggtaaaatttccaattcactttcatcaacaggtaatctaaatcgttgattttcttccaattggttactcataacgacttgcaaatataaaataccgttaagattgaccgcacttaaaatacatcctgttttacgccaagcatgttctaattgcatttcaatttcagtaccaatttctacaagtgcggcagttttggcttgcaataaatacatggcacgtttatttatccctcgatatttggctcgagctatagtttcttgtccaatataacaacctttttggaaagaaatagcttgttcgatttcttgtaaattcagtgcttgtggaataaattctccttgtccgattattgttaaaattggaaagccttgctgcatatccaagtaatcccaatattgtgtatcttgcgtatattcaaggctcattttttgttcccaacataaaatctggcgattacccaaatcaatgcgaatttgtggtgaaatagcaccgcactctttcagatcctgatcaagcatgcccacaatagtccaatttttttcactaaaagtcacttgagaaaaaaccgcatatttttttaattgagctaagccatgattgagtaaatcttggcggattaagagataaaattgttgttctgcatgacgaatcagacggaaaagagaattgactttacctttcggatcgcaatgtgcggttaatgtggattgaccgattgccaactttgttacatcacaggttaattgtccttgtaaaaatttttcggcatcaacgccttctacataaattaaaccatattgcttaagattaattaacatttttgtccttattcaagattttggatttgttcacgcatttgttcaattaagacctttaattcaaccgctgatgaggtaatatcggcgttaatagatttagacgcaagcgtattactttcacgattaagttcttgcatcataaaatcaagtttacgcccgacagccccgcctttgtgcaaaatagcgtatgtttcttttacatgtaattgcaaccgatccagctcttcagctatatcaatacgttgtgccaatagcaccatttcttgttcaatacgttgtgtatctgcttgtaattgaatttcatcaaaacgttgttgcaaacgatctcgttgccattgcaatatttccggcataaaagaccgcactttttgtgtctcaacggaaattgccataaggcgttgttcaattaatttttgaactttttctccctcacgagctcgtgttgcaataaactccacaagcaaatcatcaaaggcttgcaacaaatcttcgatgatactgtccaagtcctgttccggcgtttccactacaccggggtagcgtaaaatatccatcagattgatttcaccctctccggcttgtgcttttatatattgcaaagattgaataacctgtttggcgaacttttgattaagatttaagttgagtgcggtttgttttttagtgtcaatacgcaagctacattcgattttacctcgagccagtttttgccgtaatttttcacgcaaagtattttccaatcctcgaaattgctccggtaaacgaaaaaaggtttctaaataacgttgattgaccgagcgaatttcccatacggcatccccccattcttttttaatttcaacacgagcaaaggcagtcatactgtaaatcatatttttatatcctcacttttatattaatttaccggtgctattgtactgttaaatttcttttatgtcagtttgcatgataaaattgcaaaaattttttaacttcattcaaaggaatatgtcatgcgtccaaatgcgagagcaatcaatcaaccccgtccaataaaaattactcgtcattacactaaacatgctgaaggttcggtattagttgaattcggtgaaaccaaagtgatttgtacagcgacggttgaagatagtgtaccacgttttttaaaagggcaaggaaaaggttgggttactgcagaatatggtatgcttccacgctcaacccatagccgtatgcaacgtgaagcggctaagggtaaacaaggcggtagaacgatggaaattcaacgtttaattgcacgctcattacgtgctatggtagatttggaggctttaggtgagcgtgcaatcacattggactgcgatgttattcaagcggacggaggtacgagaacagcatcaatcacgggggcttgtgtagctttaattgatgcaattaattttttgttgcaaaacggtacgttgacaactaatccgataaagggattagttgctgccatttctgttggtattgtcaacggtgaaacggtgtgtgatttagaatatgtggaagatagcattgccgaaacagatatgaatgtggtgatgatggaagatggacgtatgattgaagtacaaggaacagcagaaggcgaaccgtttagccatgcagaacttcttaccctattagatttagccaaacaaggttgtgaacaactttttgtggcacaacgtgttgcattagcggaataaagatagtttgtgcaagataaaaaatctacaatatacatttttacaatgtaagaatatcgcaatgaaaatggtgtggaaatacaggggttaaaatgaattttctcggaaaaataatcggttttatttttggttggcgttttggtggtttttttggtgctgttgtcggcctaattctaggacaccttgccgataagaaactgtatgaattaggaagtgtaaattccagcttttttaaaaataaactcactcgtcaatcgctctttatgcaaactacttttgccgtattaggacatttgaccaaagcaaagggtagggtgaccgaagatgatattgcccttgcaacaagcctaatgcagcaattaaatctggatgatgcaggcagacgtttagcacaagaagcatttaatcgtggtaagcaaactgattttcctctccgtcaagttattcgagagtttcgtttaggttgtggacaacgagcggatttgttgcgtatctttttgagtattcaagtcaaagctgcttttatggataatgaattgcaaggtgcggaaaaaagtgtcttacaaattgtagcagaagagctagggttatctcgtttccaatttgagcaaatacttgcgatggaattagctactcgacactttagtcgtggcggtttttatcaacaaagtcgtacttaccaacagggaagttatcatcaatatcaagagcaaggacaatatcaaaacagctatcatcaatcaggcccaacgttagatgatgcttacaaagtgcttggtgtatcaggaaatgataatcaacaaactgtaaaacgtgcttatcgtcgtttaatgaatgaaaatcatcctgataagttggtttctaaaggattacctcctgaaatgttggaaatggcaaaagaaaaagcccaacaaattcaagcggcgtatgatttaatttgtaaatcgaagggttggaaataacttaatgcgagtttttttagcacctatgcaaggtgtgcttgatccttttgtacgtcaactattaacagaggttaatcaatatgatctctgtatttctgaatttgttagagtagttgatcagcgtcttcccaacaaagttttttatcgtttatgccctgaacttcaccatcagggctttactttgtctggtacgcctgttcgtgtacaacttttggggcaatatccgcaatggcttgctgaaaatgcccaaagagccgttgaattaggttctcagggcatagatttgaattgtggttgtccgtcgaaagctgtcaatggaagtaatggaggtgcttcattgttgaaacaaccggaactcatttaccaagcaacaaaagctattcgtcaagctgttccaatggaacagcctgttagcgtaaaagtgcggttgggttgggataatgttgatcaggtttttgaaattgccgatgcggtacagcaaggcggagcaacggaaataacgattcatggacgaactaaaagcgacggttatcgtgctgatcggattaattggtataaaattgctgaagtcagaaaaaaattacgaattccagttattgccaatggtgaaatttggcattggcaagatgggcaaaattgtttagccattactggttgccaagatttaatgattggacgaggggctttaaatattcctaatttaagttatgtaataaaattcaatgcggaaaaattagattggcaacaaggtgttatgccgatgttgcataaatatgctcatgttgaaaatgaatttgacaaagggttctatcatattgcaagaattaaacaatggctacaatacctgaaaaaagagtatcctcaagctggcacactttttgagcgaattaaaagctgtcaaagtgcggcggaattacggcataaaatacaataaaaatggcgtgtaatttacgttacacgccatttttcaaccaatgtatttattttacacgagaaacatattcacctgaacgggtatcaactttaatcacttcgccaatttgtacaaatagaggtactttcactaccgcacctgtacttaatgttgccggtttgcctccagttcccgctgtatcaccttttaagccaggatcggtttcaacaacttccaactcaacgaaattaggcggtgtaatcgttataggtgcaccattccataaggttacaatacaatctgcttgatccagcaaccatttttccgcatcacctaccgctttggcatcagcagagtattgttcaaaggtttcaggatgcataaaataccaaaacgcttcatctttataggagtaagtcaggtttaagtccattacatctgccgcttcaactgatgtaccagatttaaagttgacatccaatactttgcctgaaattaatttacggatacgggtgcgagtgaacgcttgccctttacccggtttaacaaattcattttcaataataacgcaaggctcaccgtcctgcataaattttagacctggtttaaaatcactggtagtatatgtagccatatcatcctcaaattaaaagagattgtttttaacaaatgcgtattctaacccaaaatagcataaatagagaagaagaaaattggactgattacctcgcaaaggcaatttccgatcctatagaattacttaattgtttagagttaccgattgaatcgtttcagtatgacattgcggcacgtcaattatttccattgcgtgttcctttcccatttgttaaaaaaatggaaaaaggtaacccaaatgatccgctctttttacaagtgatggcttcacagcatgaatttttgccgatggcaggatttaccaaagatcctttggaagaacaacataacagtgttcccaatattttgcataaataccataaccggttgttattaatagtaaaaaacagttgtgccgtcaactgtcgttattgtttccgccgtcatttcccttatgcggaaaataaaggaaataaacaaagttgggtaaaatcgctggattatattgccgcacatgctgaaattgaagaagttattttttcggggggagatcctttgatggctaaagatcatgagttagcatggttaataaaagagcttgaaaatataccgcacttacataccttgcgtattcatactcgcttgccggttgttattccgcaacgcattactgatgaactttgtcggatattgagtgaaagtcgttttcaaaaagtcattgttactcatattaatcaccccaatgaaattgatgaaatattagcctgtgcaatgaaaaaattaaaacatgcgaatgtaaccttacttaatcaatctgtggtgttaaaaaatatcaacgataatgcacacattttaaaaaaattaagtgataaattattcagtatcggcattcttccgtattatttacatttattagataaagttgagggagcaagtcatttttatcttgatgatgaaagtgcggccgctatttacaaagaattacaacgcattagttcgggctatctcgtaccgaaacttgctcgtgaaattgctcatgagccgaataaaacgttgtattcggcataggaaaaagaatgaagatcctttaaaatacataaaattttaccgcactttatgtgcttctttaaacataactttctgactcatcaagggactatcatgacagctgaacaaaataaaatcgacacctctggacaagcttctatacaaaaagaattggagcttgatctggatcctatggagccgatacttccgaaaaaaaatcttgcacctaaacaaactttattggaaaaagccaaacgtattttcaagagagcggataagcaaaatagagttgataaagcagaagtgagtacacataaagaagtaatatccgctagtgatgatgaacaacgtccaataatcacggaaacacaagagcaacaaataagccaagcaatagacccgactatatctgaagtgcctgttaagacacaaaaagaactgaaaaaaccggaaaattggactatgttaggtgtgttaccgcctaaatatcgccgtatttttattgcattattagttgtcgtcattattttattaattatttcttggttaaaaccggatgataatatagagcaatattttgaacaatcaacaggcaatagtattccgacacaatttcagcctttagatcattctcaaccggttgaaccgagcattttagagcaactgaagaatcctcaaccaaaaagtgaaaatatcacacagaatgatcaggaaaaaaatatgcctgtacaagcgttgcaggtagaaaatgaaccccaaaatatagctataccgataaattcaacacctagtaaggcggacagtccagtagtggaaacaagcaagcgaccaagtattaaagttgaggaagcaacatctcaacctatagcaccaatggaagaagtgaaaattgttgagaaaaacgagccaaataaaaaggcagaaaaacaggtgaaagcagagcagaaaggcgtgcctgttgttgatgcgaaaccggctaatgtgaataaagtaacaaattcacagaaaaccgctctacaaaaaaatgcacagactaaaacccttgttattccgcaaggaacatcactgatgcaagtattccgcaacaacaatttgaatattgccgatgtcaatgcaatgacgaaagcaagtggggccggtaatacattaagtagtttcaaagcgggtgataaagtacaagtatccttaaataagcaagggcgtgtcaatgaattgcgtctatccaatggtgcgaggtttatccgccaagccgatggaagttatcaatttaaaaaataatgatattaagcaaaacggcgtaattttcagttacgccgtttgattgtcaagctaacattttttctatttataaccgctctttttctccaccgaattcatccaacaaattttccgttaatttggcaagaatgcctgtcattaaaacaaaatccgcatcaaatcgttgtgcaaaatcttcttttgaaatatcgtcattttgttcacgaatttgatcggcaaattttaagcgttttaaactggcatcttcgttgagagtaaaacttaaatgttcttcccagttgagggataagtttgtgatatatttgccggaatttaacaatccgatcatttcttcactgtccaaaacttgttgtttgcaacgaataacggcttgatcttggcttccttttaattccgcctcttccaatacagtcaaccattgaggtgagttttccttaacccaatttgtcatcaccaaacttggctcattagcaaatgcaagtggcacaacaggtaaagatcctaacgattttcttaataaagccaaacagtcttccgctcgtttagttgaggcggtatcaatgtaaataaggttattttccgtatcaatccacaacgcagtatgttggtttttactgaatgcacgaggcaataacgtagcgacaatatcatcttttaacgcttgtttttcgatttttttcagtttgcgattttctttttgctcaagttgttcaatccgttcttccagctcacggttaatcacttgtgcaggcaaaatcttttcttctttgtgagcaactaacaagagttgttttccaacacaaaaagagagagattcactttcacgcaaaggattgtgccaaccgaaccggctcatgtctgattgttggcagggagaatatgcacattgttgtaactgtgattgtaaattttctaccgaccaatcaagagatttagttaaacggtaaattaaggcatttttaaaccaaaacattgttcttcctcaaggtttttcatgtaaaataagcactattgtaacttattcgagatgaaaatatgcaacataaattgattagctttattggtggaggaaatatggcacaagccattgttttgggattattaaaacaaggctatcctgcacattacattcgtgtttgtgatccgaaccaatttcgccgtgatttatttattgcgcaaggtacgcaagtaagtagcaacaatgtcgaggcaatacaggatgcggatgtagttttacttgccgtgaaaccacaaattatggcggaagtttgtgtaccgttaagtgcggttgatttttcagataagttagtgatttccattgcggcggggatttctaccgtaagattgaccgcacttttacccagtgcgaaaagtattattcgtgttatgccaaatacgcctgcacttgtttcagcaggtatggcaggtttatttgcgacaccgcaggtttcggtaaacttaaaacagtttgcacaagatttattaagtgcgatgggggaaatttgttggcttgaacaagaacaagatatgcacgccgttactgccggttcaggaagtagtcccgcttatttctttttatttatggaagccatgcaacaggcattaattgaaatgaatttagatccgaaaactgctcgcttattagtgcaacaatcagcattaggtgcagcgaaaatggtgatcgaaaatccacaaatcgctttatcggaactaagggaaaatgttacttcaaaagggggaacaacagcgtccgctttagcggtatttaatgaacaaaatgtgacgcaaataaccaaacaggcaatgctggcttgtgttaaacgttcacaagaaatggagagtttattttaaatgagagtttcaccattcagctggattgcaatttgtttgtttggctatttttttgcttacggcgtgtttgttccctattttcccgtgtggttaaaatcacagtcctataatgaaaccacaattgggttaattttagccggagcttacttttttcgtgcattaggcggaatttgggtttcctctttggttaaacgtccctcacaacttattagcggcttgcgttatttagcttgggcaacttgtgtcttgatgtttgtcgccggttttatggcaccgcacttttggctactttgtatcttaatcggactgttttcgatggcaagttccggaggattgccattaatggacacgctttctaccacttggcaacagcaacaaggtttagattacggtaaagcacgtatgatcggttctattgcctttgctgccggtgtggtgattttcggctatgtgatagaaatgattaatgcgacaaatattgtatggatgttgaccgcacttttattcatttatgcaatagggcaaatggcaattccaacttatccgccactcgatcatattgaatccacacaacaagaaaataatgaaacggaaaaaacggattttagcttcatacaattattaaaaaacaaagttacactacgtttgcttattgcgatttcacttattcatggttctcatgctgcctattattcttacagcgtgttatattggcaagaagaacttcatattccgcttcaagttattggggggctttgggcattaagtatcgtggcggaaattgtcctcttcttcttttcatcaaaatggtttcgacactggaaagtcagcacattattttatctttctgcgttaggtgcagtggtgcgttggggcggtttaagttttgcggacaatttgggtattgttatctttatccaacttttacatagtatcacttttgcgaccagtcattatgccattatccgctatatttccacacaacctcatcaagcgatggctaaattacagggcttatataacagtttttccgcctgtattgcagtcggtttattagcgggactttccagtcttatttatcccatctcaccgttttatacattcttaactatgatgttgattgcggcactggcgatccctattattccgagaaatatcaatgcctttcgtcaaagtatcatcactcgagtgaaatcatgaaagacaacgcattaattgatctttttttaaatgaactttggttagaaaaaggattatccgagaataccgtgcaatcttatcgcttggatctgaccgcactttcgcaatggctggagcctcaggggttgagtttagaaacccttgatgtggtagatttacaaacattcttaggcgagcgtttgacacaaggttataaagcaacaagtattgctagaatgttaagtgcattacgcaaactttttcaatatttgtatcgagaaaaataccgttcggatgatccaagtgcggtgttaagttcacctaaattaccgagccgtttgcctaaatatctgacggaacaacaagtaacggacttactcaacacacccaatacagaaattccgttggaattaagagataaggcaatgttggaaatgttgtatgcaaccggattacgtgtaacggaattggtgagtttaagtcttgatagtatcaatatcaatcagggtgttgtgcgagttatcgggaaagggaagaaagaacgtattgtgccgatgggagaggaagcaaactattggcttcgtcaatttatcctatatggcagatcctttctcttggcagggcagagttccgatgttgtttttccaagccgtcggggaactcaaatgacacgccaaacgttttggcatagggtaaaatattatgcaatattggctgaaattgatacttctgcactttctccccacgtcttacgtcatgcttttgctacgcatttagttaatcatggtgccgatttgcgtgtggtacaaatgttactgggacatagcgatttgtccactacacaaatttatacacatgtggctaaagagcggttaaaaattttacacgaaagatttcatccaagaggataaatttttttatatttttttgtacacctgtatcgtataatgctccgttagtttaaaaagacaaagttaaactatttaaaaaattcatttctttgatacataaggagtttttatgaaatacaaactatctttagcaattctgtcaatactgcccgcactttcccatgcgggggggggtaatttcaacttttacggcaaagcaggaatcgatttaacctctcgttttgaaacaatggttctcagaacagaacaaaataattacgtcccgagtattcctgcaagttcaagacaaaataccttctcgccaagtatcttttttgaaactacctacactattttaccgcaaacagaaatcggtttgggactgggctatatcaaacgcaaaggcttcgatcattctgccagttggcattttgagaaggatgtagataaaaaaacatgggcacaaacatctggttttaccgacatcgaaaaatatagaatttaccgttattcttccctaccaatttatctcatcttgaaacagaattatgcgtttaatgcaaacagcaaattttatctaaaagggaatataggttattcaatcaataaaatgcctaatacaaagtatgctcattattcaaatgagacaagcctaaaaattcagaaaacacaaattggcgatcctatttataaaatgaaagcaaaaaacgggctgtatttagggttgggtatcgggattgaatataaatctttcttagcggaaattggttattaccatacccatgcaactgtcagttacaaaaacaaaaatacccaatatccacaatattcctacaacaacgatgccatacgtttaacccttggggtgaaattctagaaaatgaaaagcgactaactgcggttagttagtcgcttttatagaaaatttttatatttttttgtacacctgtatcgtataatgctccgttagtttaaaaagacaaagttaaactattttaaaaaatttatttctttgatacataaggagtttttatgaaatacaaactatctttagtgcttttgtcaatactgcccgcactttcccatgcgggggggggtaatttcaacttttacggcaaagcgggaatcgatttaacctctcgttttgaaaccatgcaactcagaacatatctgaacaatgacgtaccgagcattccagccagctcaagacaaaacaccttttcaccaagtatcttttttgaaaccacttacactattttaccgcaaacggaaatcggtctaggattaggctatatcaaacgaaaaggcttcgatcattctgccagttggcatgtacatactgatggagaatgggtgataagtggggacaatactgctgttgagtactataaaataaatcgctattcttccctgccgatttattttacgctaaaacaaaattatgcctttaatgcaaacagcaaattttatctaaaaggggatataggttattcaattaataaaattgctgacaccaaacataagaaatacacaaatattacaaataaatttgagttactaagtgaaaatctacgtaaaatgaaagcaagaaacgggctttatttaggtttagccattggacttgaatataaatcgttcttagcagaaatcgggtattatcatacccacgctgcggttaattataaaactaaaccttacaaaagcaaagcagaaggctactatgcttggcattcttacaacaacgatgctatacgtttaacccttgggtttaaattctaaaaaataaaaacgtgattaattgatctgcacctaaaagttggactaaacaaccaacgattagtgtgcagatttttatgacaaaagataacccatctttcaaatagcaagccatcgttgagttttatttatcaaaaaagcagtgagtaatcactgcttttttatggtcgtttaactaggttaccaagcccagccgatacccacaccgccaccgaagtcgccgacagagttgctatttccgtgtaatttcaacagaaccttaccgttatcactcacacgagaatagcctaaagcgaccgcactttgacctttatacgtaccggcagagactgaaagcactgatttccccggaatcgaaatcgtaggcaatgccgccgccgcattcgaaccggcaattcctgctcgagattctttactaaacgcatcaaacctattttcaagctggttgaattttttgtcagtatgtgtttgtaaggcatcgacatatcctttgttaaccacggcattcggtgaagagttcggcgttaaatccggcactctgatttctcctttcaccccgtcaatttcaatacgttgaccttgcgggttggtcaaggttaatccgcttggcgtcaaagtcgcactgtgcttaccgacagtcaatctcacgccgtctaccccatattgtgccgatttgccgtctttatgggttacccgtaatccgttgccgtcaagacgagatttattcccttctgcgctttctttggtttcaaaagacgtcatgtttttcaacgtgtcggacagtttgacttccagtcccgtctcggaggcgtccactttaatattgcccgctgccgtggtcryactgttaaactccccctcgcctttgatggtcaatttctcgcctaaatttttatggacaggcacgccgtcattgccctcaaaatttaagcccgcttgtcctaargcytgyaagtcttgcagattggcagcacgcttaacatcaattaaggacttatctgacaacaacttattgactgcgtcatcttttgtggctaatgcgatttgatacgctttttgcttcgcttttaatatgccttgtgccgattcaacctcttttttcgccttatccaatttcgagttaatgtcggctaatgttgatttttcgccctcgatcttagctttggctttctctttcgccgctttttcctccggtgtagtttccggcatgaaagacaatgcggtttcaagagcgtcaatggcgtnnnnnnnnnnnnnnnnnnnnnnnnnnnnnnnnnnnnnnnngtctacttttttcgccaccgcctgtgcttcggttttcactgcttcgcctgcatttttcacgtttttagcttgctcttttgctttatcggcatcaatacccaaaccgctcgccacgttgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatacaaaagaataatgaccttctactttattttctttacctacagatattgaactaagacctaatacatcagaatcttgtcctattgatattgcaccttgattttttgcgaatgaattataacccaatgctatcgaaccctcattttgcgataccgcattatgtcctatagaaattgaccctgttcctattgcttgtgtttttgcagaatcagaaagtttaacggatttatcccctgtgcctttcagatagtcgactaaggctttggcttgtactaattcgcttgtaccctctgtttcatcttctttaagattgattttatcaatgccgatattagaaccaaaaatcgctttatctttaacatttgcaccatctatttctaaataatactcttctaaatcccctactagagtatctctttgagtatattttttaagctcttccgccacagctttagatgttacaactttgtcactatctgggttaaaagtcgtttctttatttaacgttaacgtaagtgctttttctgtagcacttgctgtagccattatatctacaccagttccatcacctttgattgtgatagtctctccaagtgcaacgttggctgtaccgctatttcctgaaaatgttaatcctttaccaataatcgctttagccacatcagataagtcttttacgtttatggcattattttgaatagtatctatagacgttccagttaatacattttcaatattagttgctacattatttgcagtcgaatctcctaaaccacttgcaacacctgaaattttaactttatcactgtctgattttgtgaatgttaatgtcgctccactttcagggcttaactcaatttgctttttaccattacttgtaattttaagacttccagcatcagttcctgcagtgatggtcgcctcattctcttttaattcaagttttgatttatcatgagctaattctacagttgctttatcagcattaagtgtcaatttagatttactgtctttactactaatttcagaaacgccactgaatttatcttctgttaatgttacagttttacctgaatttccggctgtgaaaacgatagattttccacttccattagttccattgtttaatgaaattttcacatcgtcaccattagcaactgattttatgccggttaaagcatcttttaatgtgatacttactgtttgcttattcttatcaactttagtgtcaatatttttgctatctcctgcaattgttaattcattatgctctttatctaatgtatatacttctttattatccttactattatcacccttaaccgtaaaattagctgcgactttttctaatcttttgtctaaatattttttgttgacagcatagttatcataagtatttttcttaggattagctggctcgtcttcgggaatatcattttcaattaatacatttttaaaagtaggtgattcttttattcctattaataattgcttactatcttttagatatgctgttttaatattatcaggaacgtatcctccatcttgagtagtagttggtttatctacagctcctgctttaatgattaatttatcacctaaataatgtgtcccctgtgcagtttcttcttctccgcttccaaaaataaagcccttattaatttgatctatatttgcatctattgccgctttaaatgtttttgcttcttttagtatctgtccattttgttcagttccatttttaaatttattaaattgtgattttttaaatgtaaatttaccgttatcaacttccgcacctaatacatttgttgcaaagttctttaattgtaaaaagttaacagcatgattgtcattcgttggtgcttcagtaattgttacactcttaaattcaggatcgtcttttaagccgatagtgaatttagcaacggaattgtttgttttgccttgttcaaatttcgtttctaaatttttaccgacatattttgttttactgtttgattcaatatctccatttacaatttcaatcgtagatcctaaataaaacggtgtatctttatttggatggtcaggagtaccatcactaaacttatacccagagttaatcgctgcaatggtttccgttaaagcagccttaaaggtatcttgtgatcccttgtctccagcttcaacataattcacagcagtaaaatcatgttttttaaattttgtttgactatctttttgatattctaatcccaatgcctcttttgcactatttaactgtgctcccgtaatcgcctgatcggaagtcgctgaaatttcgccatcagccaaatgtccaaattttattgtttcccctatgtcagcagttgtttttccatcagcaaatgtttgagttttttcatcaaatcctttagcaccaacgaagactttgttcttgtcaattttgcctaatttttttaaaggttcgccatttcttgtatctactctataaaattcaccgtcatctgatgctttcattaatttaactattttgttattgttatccactgtataataaacaaccaacccctctttttttacatattctaatgtttttagctgaccaacagtcgccacatcagaatccaacgctcccggtgcaacatttattattcttctaagtcccactgcctctgtgtttgtaccttcgctaaccttccaaccaccaacagatatcaccccataagaggcatcattttttatttcgtaagttgaacccgcagctttataagcatctaatttagaagctggttctcccgataatttaggcgtaaatttgtcgcttgcatctgctttgttatcataaaaataattagttgttgatttatatcctaatgcaacagaattagacaaattggcttcagcttcattacctaatgccaacgcacctgtagcatctctacctacacctgcttctataccaagtgcgatacctttttccgcttgagattgtgctttataaccgatagcaactgaatattgtttacctgaatacgtattattccctaacgcaattgaggcttgaccaatggcacgtgtaaaactccctattgcaaaggcatctttttcttttgcaaatgaaaatcttccgattgcaatcgcactatcttccttggcgtaagcatatcgtccaattgttagcgcattgtctcctaatgcgaccgaatacgaacctatcgctattccaccttgattatatccgagtgaatctcttgattgtttcgcttttaattcttccgttccctcttgtttggtcgttttaggtttgattaatctagaataagtttgtatatctgctgtatttcctttttcatataattcttcaaaatcaaattttgcaccatatgaatttttactatccgttaaagtaaagccattattattttgaagtccatcattattgaaattatcatccatctctatatttgctaatgcataatttccaattgccaatgaacctctaccgcctgcatacgaatcggaaccgtataccatagcaccatcattaattgcttgtacattagtacctaccccaaccgttctatctgcatacacatacgatttgtttccaagaactaatgattctttaccaaatgcgattgtatctgaaccaattgctgttgaataatctttaaaggcaatggcaaacgttccgattgcagtcgtataatcaccgtatgcaatacttcttgccccaaccgctattgcatttttccccctggcccatgtgtgagtttttctattatcgtatttaactccatttaaatttttttctttctctattttgtttctactgtccttatctaaatatttttcataggcgacatttactttagaatcatattcttgttttcgtagataatcgtctttcttttttattttttcaatttcatctctttctgtaactttatcatataaatgaccattttttttataaaaaacctcttcaccattatcatttttgataagataataactactccatgttttaccatcatctcttacaaaataatctccatttaatactagagcattaccatcttttcctactaactcccctttgccattaacatattcattttttccgacaccactaatatctaataaaaatctaaaatcaactgccggatattcctctgtatagttaaaattttgtgcattatctagaaacaatctaaagatgtcttttggtagttttttttgttttgcatctgcatttccgataccgtctgatccaatcgcaattgaagaatctccccaagcaactgtatcattccctaatgatgtcgcccctgctcctctcgcaaaggttctatatccaaccgctgttccttgtgcgttagcattatcaatatttttatctttagtgttttctccaacaatcgctttatatcctattgaggttgcaccaattccaccacccacagcacgagaacctataatgactgcatatttggcgtgttgattttcaatactagattcagcacctgctttatttgatttgtctgctaataatattagttcttgatgcttttttttaatgtcttcattcgctccttgataccaaatacttgtattgtagttagatttaccgtattcgctggatgtattattatctatccacacatctaccccatacgctacactcgacacccccgatatcgccaacgccaacggcaggaccttaaacgctcctaacacaccgccgaaaaacacaccgcacttcggcttactctccgaactgctcgctatttggcgattgcttgccaactcggaaacggctttacattgacctgttgtaatatcatattttgttttgaagattttgttcatatatctattctctttaaaaatggatttttaaattaatgatttcttgcgttaattaattgtttagtaaactttgtaggaattggttataaacctaaacnggaaatgccttgctttttaaggcacagcagaaaaaggcgaatgatatcttcgctaagggttttaaaagggtagattggggtatgacgagaagttaaaaactttttaaaatttattttgcaaggtttataaaaaggcgttagcctaggctgtaggctgtaggctgtaggctgtaggctgtcatttttctattctatttttgtttgtcaagtaaaaatccggattattctatctcaaaatttttatggaaaaaacaattttcttacgtttttattctaattcagagggtgatttttaattacgttgtttgatgtcaaagcgaaatttaatgaaaatgaccgcactttttagggtaacaaaaatccctattgggtgagacttcaatagggattggctgtttttaaattatggcaggaatactattttttccaattatattcaggattgataatatcttctatttcatgccaataagcagttaatacgacattgccataagcataagcccgaagtgcatagggcggataaacaaagtttattccttcattattgaagtaaaattgttctgaaatgttgaaatcttcttttgtgatcataccaatatagtcatcattcgcttcttgcattagattggtataaaagctccaaagtacttctttcagcttggtttgttggtcttgctgaatgatgtcgtttacttcaagtattttctttttatgactatcaatattctgatatagggttacatttatgccgtgagcaccaccggtataagtatcaatatcgttgctgaacgtaatgatattattgcgttgccctagataatttgacgttagatggaatgatgcacctaatacacggtcttcttttgcactttgaacgaattcatcatgaatttgttgaaatttttgtacaagatcttgttttgtcggcgtatcttttttcatgctatcttcaccgcccactaaggtataagcatgtttgagcaataactgatcaagccattttataccggtttcggataactcaccacgaacttcaatttgtgcattgtcagtagtatattcatcggaatgcgggtaatttacggtttttacttgatcaaagataacatttttcttgacttgtaaagttggaacgtcttgttcctgacaagctgccaatagaacagttgtcataagagagaagaataaaaagatttttttcatatgattgccaaagtttagtggagtaagaaagtctttattataagttggcagagtatgaatgtaaatttttcttttgggtaagaataaatcgatatattaagtcgctattcttccgtataatatgggttttatttagatagaacgcaaggatattttatgaagcaaactactcaatcgatgaatatagtcgatatgttgatcgttacagtgatcttttttggcatgccgatttatacttctctgtcgcaatttttcttattgcaagaaggtgcggtcgcaattacagacacgttgacatttacggatcaggataatatttgggcaattttgatagaacttatctcattagcgattgctgcggtgtatttaaagctaagacgctttgattttacgcagcttaccttttcttttaacgctaaagcgattgtgctgaccgcagggataattttgattgccggtagtctcagcgaactttatttctatttggcagctccctttcaagatgccggtgcatatctcacttcggctgaggttgcacctacagatacaacatcgaccttatctttttacctcgtcctcttttcattgctcaacggtttttttgaagaagtcttttttctcggcttgatatttgcagtaaataaaaaagccttgccttatgcgattgtgttcagcttagtcatccgttttttgtttcatacctatcaaggtatgttttatgcagtaaacgtattgttattcggtatcgtgttgctaatacttcgctctaaaatcaaaaatttattaccgtttacgttagcacatgcgttctttgatgtgtttggattggggttgttgcccattattgatattgtcgaaaaaattatcaaataaaaaggcgtattaaatacgcctaaataaacaatcggataaccgttagaaacggtagttaagatttaaaccgtataaattggcacgtgccgttgattgataatccgcacttatattaacgagtttaatctcttttccaatattttgtgtttctctaaattgctgttttttacctcgtaaatgagcaaaacctacgtcaacagaaagatttggcgtgaagttataggttgcccccaagctataccaagtgcggtcggtatcggggattgaagcacttgggtggtcggctgactcatcataagcaatacctgcacgcagggttaatttatcatttacatcgtaagttgcccctaaggctatacgtgaactgtcatgaaatttttcatctttatggaaagcgaccttgccgttatcataagtggcatgtaaactttgtaaacggctccatttagtatatttatagctgtagtgcatggcgaatttttccgttaattggtggaaaccggaaatttcgaaataatccggcaaatgtagcgttaacccacctttctctttaacaggactaattcctcttggtttaagttgataactcaacgcatcatcatctttaaaattaatatctactttagaatgataggcaataccgatacggttaccttgattaaattcatagactgccccgatattccaaccaaatccccatgcattattatcttgtaattgtgttaaggtggtatccgcattaactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaacacctgcttgtcgttcaattttcgctttggcataaaccgcattcaacccagcaccgatgcttaatcctttgctgatacggtatgaaccgcttaaatttaagttaatggaattcagtgcggtggttccacccaaaacaccggcatcataatcctttttatatttactttgtaacccaaagttcacattcatgcccgcaccgacagcaaatttatcattaataggtgcgacgaagtacatattgggaataactgcacttggcacaatgtttttctgatccccttttccagttgcaattccgtgaaataaccccgcattaacattaacctcaccatttatattaattctagattgaacgtataccccccccattgagaattgtttcgttttaaacaaactcattaacgcagggttggttgccacaacagcggcattatcagcaatcgctgcctcacccgcataagctcgccctaaaccggaactggacacctcagcaatttggaacgccgctgcattaacgtaacttgccgataatgccaatgctgaagcaatgaaagatttagtaaaaagtgattgtttattgctattcattttttatttaatacctctatatatggtgaagttaaattttccgaattctaatgtaagagtagtattgggacaaatgaatttactgatttgttcagtggtcataccaggcggaaatctttcatttactaaagtttataagaagaatttagctgtggcagacaataaatcagtgagttctagttcctcattttgtagaatgttaaaaactttttattgtgttttttgggggaagttataaaggttgagtaaaaaattgtataattcgttataaataacgcaatataatgatttaatgttaaggaaataggaatgacattgtacaaaatattggtgaatagcatcgctatgatttgttttagcgtttcccttgtagcacaagcaaaaataacggtttttgccgctgcttctatggcaaatgtgttagaagaaattaaatctgaatacatcaaagtaaatcctcagcaggaaattgatttttcctttgcttcttcttctgtcttagcacggcaaattagtcagggagcacctgcacagttgtttatttctgcggatcaaaaatggatggattttttagcggaaaagggggcaattgtgacagaaagtcgtcgtgatttggttggtaacagattggtgatgattgcacctcaaaatagtttgattacctctgttgatttgcctaacgctcaatggcattctcatttgaataatacttatcttgcagtaggtgatcctgatcatgtaccggcgggaaaatatgcaaaagcggcatttatctttttggggcaatggaatgatttagaaactaaattagctcgtgcaaataatgtgcgtgcagctttagcattagttgaaagaggggaaagtccgttgggtgttgtttatgcaacagatgcggcagcaagtaaaaaggttaaaacagtggcgatttttcctgaaaatacgcaccctgcgattgaatatcctatcgctattgtgaacgggcaagataatgaagaaagccgcaagtttttggcttatttgcggtcagaaagtgcggtcaaaatttttcaacaattcggtttttcagtgaaataatttttatgttagatgtgataatcgattatctacgtttatctcaatctgaaatcaatgcaatctctttgagtgttagagtggcattggtttcaatttcggtgagcttaccttttgctattgctgtcgcatggttgcttgcacgcaaagatttttggggtaagtcgattattaacggtcttattcatttaccgcttgttttacctcccgttgtaattgggtatttattattaattgctatggggcgtaacggtattatcggtcgctatttactacagtggtttgattttagttttggctttagttggtacggtgcggcgttagcttctggaatcgttgcatttccgttgcaggttcgtgctattcgtttggcaattgaaaatattgattttcggctggaacaggcggcacaaacgttaggtgcttcttcattgcggatattttttactattacgttaccgctttcattaccggggattttatcaggaatgattttgggttttgcacgatctttaggtgaattcggtgcaaccattacttttgtctctaatattcctcaagtgacccaaactattccgctggcgatgttttcttttattgaaacaccgggtgcggaatattcggcatttagactttgtgttatcgccattattattgcattgatctctttatcaatttctgaatggctggcgaaacgaatgcaacaaaaattggggtaaagatacttgtaattacaagcctgtgccgagtgatgctttagcggtaatttttgattatttattttacaatcgttcattatttcctatatgaggctttatcgtgtcgttatttctatgtgctgaagaaagattagtgcaatgtgcaacttctttaattgaacagtttcctgagcaatacaacactacactttttcaacaaattcaaaaagataaacataatcaaaaaacgcaactcgggcaattaggttatggattatatttatcagattttgtgtttgaaactttgcaaaaacaaccgcactttctcaaacaatgttggcatcaactccctactttagctgattgcgatcgatatttcgttcgcttacaggaaatactgataaataccgaaacggaagaacaactgtaccgcaagttacgtctatttcgtcatcgtgagatggcaaaacttagcctttgtcaaagtttaaatttagctacagtagacgaaatttttattcggctttctcaattagctgaaagtttgatcattgccgcaagagattggctgtatgaaaaaatttgcacagaattggggacgccaacggatacacaaggcaatcctcaacaattatatattttgggtatgggtaaattgggtggatgtgagttgaatttttcttcagatgttgatttgattttcacttatccgacaaatcagggggaaacacggggaggacggcgtagtattgaaaatggtgtatttttcacaagattgggacaacgcttaattcgtgctttagatgaatatactgttgacggttttgtatatcgaacagatatgcgtttacgtcctttcggtgaaagcggtgcattggcattaagttttaatgcgatggagcaatattatcaagatcaaggtcgagattgggaacgctatgctatgataaaagctcggattttgggagcaaatatgcaagatccgaatgtaaaaatattacagcaattattacgctcttttgtttatcgccgctatattgattttagtgtgattcaatctttacgtgatatgaaaaataaaattgccggtgaggttcgccgtcgaggattgttggacaatataaaattgggtgccggcggtattcgagaaattgaatttattgtgcaggtttttcagcttattcgtggcggacgtgaaattattttacaacaaccatcgctgcttcatcttttacctgcactggaaaaattgggtttaattgataccgagcaaagcacaaatttatatcatgcctatttatttttacgcagagtggaaaatattttacaagctattgatgataaacaaacgcaaacgttgccaagtgcggatatcgatcgtgaacgtttacttcttgctacaaaaaattttacctattttccgatatcgacggaaaatgcgggaaaagaaaccgcacttgctcaatatcctattgcaaattggcagcaatttttacaggtattacatgaacatcagcaaaaagtgcggtctgtttttcaaaatttaattggcgaagatgacgatgaggaagaaaaacagagttatgatgatatatggcacgattttctcgatgctgagatcaatgagcaagaaattaaagtcatattgcaggaaaatcaaatagatgagcaatattttgatgaaattattgaaaaattgacacagtttaaactggatttatctcgtcgatcagtgggagaacgtggtcgcagagtattaacgcaattaatgccaatgttgttctgtcaagtatttcgatacaaacattctcagcaacttttacctagagtcttgaaaattctggataaaattatcacgcgtactacttatcttgaattattggtagaaaatccacaagccttaactcaacttcttaaattatgtgcacaatcaaaaatgattgctgaacaagttgcaaaatatcccattttacttgatgaattattagatcctaatgcactgttaaatcccacggattttcatcaatattcatctgaattacgccgctatttacttcgtttaccggcagacgatgaagaacaaattattaatgggttacgccaatttaaacaaaccgccttattacgtgttgcggcagcggatattttaggggcattacctgttatgaacgttagtgatcaccttacctatttagccgaagcaattattgaaaatgttgtcaacctcgcttggcaacaagtcagtctaagatttggtacacctgaatatttgaaggaaaatcaaaaagggtttttggttattggttacggtaaattgggcggcattgagcttggttataaatcagacttggatcttgtttttctctatgacggaagtcaaacaggacaaactatcggcggtaaaaaatccattgatagcaatcagttttatctgaaattggtacaaaaaataattagtatttttagtatgaataccagtgcaggaatactttacgacatagatattcgtttacgtcctgccggtgatgcagggttattggggtgttccttaaatgcctttgaaaattaccaactgaatgaagcgtggacttgggaaaaacaggctttagttcgttgtagggcggtatacggcgatattgatttatgtgaacgctttgaaaaaattcgttgtaatgtactttcagctccaagaaatgtggaacagctgaagcaagatatacgagagatgcgtcaaaaaatgtatcatcatctctctaaacataaaacggacgaatttaatattaagactgatttgggcggtatcacagatattgagtttattgcacaatacttagttttagcttatgctccccaacattcagcattaacacgttggtctgataatgtcaggatatttgactgtatggctgaaagtgcggtgatttcacaagaagtttccacaaagctaaaaaaatgctatgtaaatttacgaaaccaaattcatcatttaaatttattaggtcaagaaccgattattaatgcacaactatttagcaaggaaagaacgtttattctcaatacatggaaaagtttattggaatgaatgaatttataattgccctaaaatcagcatatgataagaaattatttatcatttgtattttctttgttatgctatgcagacctttaacttacattaacaaatgagaaataaacgatgaaattaaataaatcacttttggtcggcacattagtcgcctcaactgtattattagcagcttgtaatgaaaaaaataaagcggaaacaacgccaactgaaccggttacagttgcagaaactcaagctcaacctgacgttcaaggaaaaactgaaacaacytcrwctgaayyaaccgcarytgraaayacacaayctgawkctcaagaaaaagttgtttcagaaaaaagtgagacagttgaacaagaaattcttaatcagtttaacaatacagttacgatccaattggtggggtatcagagtgaaaaaatagagggtgaagatactttatctttcgtttataacgttaagaataaaggtgataaagcaatcaaagaacttcagtggtataaccttgttttctttaattcgactctggtagagcctctttcaatagcctattcttttgaggatacgcttgctccggaaggcgagggcgaaataaaattaacaaaattagctaaaacttatgctgaagagattcgtgcagatatactaaaaccggaagctaatcttcaatttagcccaataattgcaggtcgaattatttttgaagacggtacgcaattagttgtaactacagatgaagagcttactcaatctttacagcaaattttaacgcaataatttttaaaaataattattcaatgtgctagttatctatccgctcttacaagctataatatttataaataactacaaaaagttatcaataagattttatagattggtaagatcggttatgtttccgcatcgaaatctactgcccattattggcgaaaccgaaagaaattcgtcgtaaaaagcgtgcagagcaacaagaaaaagaagtgtgaagaaaaaaagctgagaatttgctaaaaatcagctcaacaaaccgcactttaataataaaaatttctgcgagaaatcatgtaaaaaaaataacaccctcttaacaagaagagggtgaataatcaatttaccattggtaccctatagaaactgaacctgccattttgccttgagaatttctatttccttgaaatttaagcataatcttaccgttatcactcatacgagaataaccaatcgccattgcgttttctccgccataacctgctgcagaaatggctaacatagatttacccggcatagagactgatgtcaaccctgccgccgcatttgcccccgcaattcctgcacgtaaatttcggtcagtattattcaattgtgtacgcaattcattatttttaccatccacatagtttttatttaccaccgcacttccagtggttgttggtttaatatccggcacggtaataatacctttttcaccatcgatcttaatttcaccacctacacctttaacagttaagccttttgcaccataggtagcagtagcagtaccagtcttatctgttacagttaagctatcgctatttaacgtcgatttcttaccgctctcctctttggttttaaaggctttcatatttttcaaggtatccgatagttttatttctaagccatcatttgttttatttgtttctaccttaatgttaccagcggcactactaaatgaacttgtagattgaccgttttgagtttcctcttcccctttaataattaaggtatcgctcagttttctatgaacagtcttattcttacctctctcattccctgcaaaacttaaccctgcttgtgcaaccgcttttaaatcagcgagattggcggctttgtgtagttcatcttttgtcatttgttgcccttgctgaccgctcatacccccagcaactaattttttcactagctcaagcgttttatcttgtcccattggttgaccttgagtgttattatcaagccctaaaccggattttagattgttgatggcaacaggtgggtgagaagtactaccatttgtgtcttttccgcctaaagtgatagtatttttcgcttcactatcatatttcactgccactttatccgcttctgcctgtttatcggcgatggtttggattttgtttttcacaaattttttcaccgcaccggcagtcgtgagttttttgtcttcagtatcagcatcctctttaatttcttcagttgcctctattttgaaggaaattgttccggtgttggcatcaatactcggtttgatatagtcatcaccttttaacttaattgtcgcaccaagctgacgtgtcattttgtttgctgtggtactgccagcctgatctgtagacgttgtagtactaccatcgtccacttcaaagattaaacctttattgatggttttaatactttcctcaatcgcatctttgaaagtagtttctgcttttactgtactatcttgaccgtctttatcttttaatttggtaaacgtggtttttttaaacgtttttgtctgcttattaacctcagcccctaaaatatccgtccctaaattaccgaatacacggataacttctgcaagctgtccgccattaatcgcatcagttgaaccgggcatcacgctacctgctgcaacgtgagtaataatgcgttctgcacctgtatcgcccatactgacgaccgaattaaatttaccatttttagaagtacctgccactttccaagtaaatattaaactatttttacctacattaatgtcagtagttttaaatacatttytcttcgtttcccatttagaatttttccccaaggcgaaagaatcatcattatccttgtcgctaagttgaataattcccaatttatctgttactttttttgccaatttaagcgtaacgttttgtttgccctgttcaactttcgtttcaatctcatcttttgtgcctaatacttgcaaggcttgcgatctgagtttaacctcagcttgtgcttttccgcttgtagatggcgtacctgtgggctgtggtggttgcggttgaggttgtgcttgtgccgtgttggaattatccgcttcaatttttagcgttaatgaatccaattgagtttttaagtaatttttaaccgcactcaccgttactaatttattgccattcgggtcggttgtactacctgaaccccccatgccttgaccattcgtatcaattgaattagccacattaagtttaaaggtgattttgcctccattgctaccgccactgccattttcagtcgccaacgtgaggtatgagtcgcctttaaacgttaaggtttcgcccagtttacgaatgaaaggattgtttccgttctgtgttgatggttgagttgtacttccatcttccaccgcaaacttcaagcctttttctacaagggctttggcgatgtcggacaagtctttcacattgacagcgttgttggaaatgttactgccattactaccaagatttccttcgaggacattttcaatattgctatttccgctacttccgccattgctatttacccctaaaccacttccaagtttagtgatttgtttattacctaaatctaagccgtctttgccaaaggtaaatgtgccagtgcctgcggtgattttgaccgttggactagttgggcyaccgctagcattcgtaaattcaatttttgcaaccgcacttccgttacttccgctaatcgtgctaataccttttaagtctttgttcaaggcgatttccaaagtgtctttgctggttttagtaaagatattttgatgagtatttggtgcactattttgccccgcacttgtcgctaggcttgaagcatcgcctgtcgctcccttaatcgtcaaggttgagccgagatagagttgttgctcgctactgcttccaccacttccgttagtatcacctttgaatttcaagccctcattgattttagcgatgtttttatcaatcgcgtctttgaaagtacttggtgcgttactactggtctcatttccacttgcatctttcaatttcgcaaaagttggcattttaaaannnnnnnnnnnnnnnnnnnnnnnnnnnnnnnnnnnnnnnnnnnnnnnnnnnnnnnnnnnnnnnnnnnnnnnnnnnnnnnnnnnnncgccgttaatcgcatcggttgaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagagtttttacccaacgcaatggaatcrccagcrtykkckkmwacwgtcgcaycytcmccaatsgckaccgcacctgtggcgttggcttcggctcctttgccgagggcgatggcggctgtggcacttgtgtgaatttttgccatttttcccaacgcaatgccgtaatcggcttcgactttggcaacgctaccgatgaccaccgcggctttccccgaggctttggtgaattgtgagttgccgctgccggtatttgtgccgtcatcgtctgccgtgccgataacgatactgtacatgcctttgctcatttccgttttcgctacgccaatggctaaagaatgatcagctttagcaccatcgttgtttttattcgtttcagcatttaatttattaacagagaaatacgagactccgccaccgccggcatttttcatcgcttctcgcaattgccctaaattgacggcgtgtgtatcttccgtccccggtgcgacattcacgatttgacggtattttgtattttttttaccgattgatagtgcaccgccgagtttgtctttgaattgatttgcaaacttttcacttatccatgttttttctttagcctcagtcttatcatcttttgtaatcataaaagtgccatttcctgacggactatcggcttcagattcagcacccaaagcgattgcatcgctatgttgactatccactctcgcattgtaaccaatagcaacggctttttgagactccacagaagaatgtgcccctaaggcggttgattgtgaaccttttgcataagcacgatgccctaaagcaacatcgtcaatttgctccgcataagattgcatacctagtgctactgtttcgttaccataggctatggcttccgaacccaatgaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatcatttaaaattgtatcgggtccaatttttgattcgttagctgttaaaccactcaaaactatattaatatcctgaccatacacaaaactcccagtcaataaaaacgccaacggcaataatttaaacagccctaaaaaattgcccgaaatcccaccgcactttggtttattttcagaacggctcgccacttggcaatttttcgccaattcagacaccactttggtttgtccagtggttatatcgtatttggttttgaaaatcttattcatggtttactctctttaatcttttaaaatgggttatttaataatttattttgttgatttttttcacttttttatggttgtgaatggattaaactttttgttttttaggtagattaatgaggtataaatcggcgatgccttgctttttaaggcaaagcagaaaaagacgaatgatattttcgcaaaggggtttaaaaggggaaatttgggtatgatgaaaagttaaaaactttttaaaatttattttgcaaggtttataaaaaggcgttagcctaggctgtaggctgtaggctgtaggctgtaggctgtaggctgtcattttttcttttctattttatttgtcaagtaatcattaagcagtagaattttgcgattctatcctaaattttattaagaatgaaatagttttttcattttttttgtttcgatctcgattatatagtgaatcaagatgtttgaggggaaagataaaggcggagtttggcttttttttggttctaattacaggttatgttttggcgagattgctatataatgtcgaattatcttaccgatttatcaattttcttttctttgggagtaaaagatgactcaagcgaagatttattccgtttcacaacttaaccaatccgtacgccaaatgttagaagggcagttagggtcggtttggttgacgggagaaatttccaattttactcagcctgtttcggggcattggtattttagtttgaaagacgaaaatgcacaggtgcgttgtgcaatgtttcgcatgaaaaatatgcgtgtcggatttaaagcacaaaacggaatgcaggttttggtgagagcttccgtgagtttgtatgagcctcgtggcgattatcaattgattattgagtcaatgaatcttgcgggggatggcttattgcaacggcaatttgaggcgttaaagttaacattggcggctgaagggttgtttgcacaacattacaagaaaaacttaccgcactttgcaaaatctgtcggtattattacgtcgcctaccggtgcggcgttgcaggatattttgcatattttgcaacgtcgagatccgagtttgcatgtagtgatttatccgactgcagtgcaaggcaaagaggcaacggcagaaattgtacagatgattgaattagccaataaacgtcgggaagttgatgttcttattgttgggcggggtggcggatcgttagaggatttatggtgttttaatgaagagagggtggcaagggctatttttcattccgagttgccgattatcagtgcggttggacatgaaattgatgtaactattgcggattttgtggcggatttgcgtgctccgacaccttctgctgccgcagagcttgtcagtcgtaatcaacaagaattattggatcaattattttaccgcaaacaacgtttggatatggcattggatcgtttgttccaacaaaaagtgaagttgttgcaacgcttgcaatttcgcttgcaacagcaacatccgcaaagccaattaaaaattcaacaaaaaacggtgcaacaattactttatcgtttacatcttgcgttaggtgcttttgtcgataaaaaacagcagaaaatgaccgcactttgtcgtcgtttagacaattcacctttgccttattatgtgcaaaaacagcaccaaattttggttcaattggagcttcgtttgaatagcggattacaaaaaaaattcaaaaatgtcgattatcagcttagtcgattatgtggaaaattagacagtttgagtccgttgaaagtgttggctcgtggttattcgattacgaaaaatcagcagggacaagcgttgaaaaacagtcatcaaattgaagtcggacaactgatcagcacgcaattagagcgagggattattgttagtcgtgttgaagcgatggaagagtaaactaaaggtgcaaataggtttgctcctttagtttgtgtatgggttgggggagttagttgcgtttaccgaaaatagcggttccaattcttaccatagttgaaccgcactttattgcacttgccatgtcatcactcattcccattgataatgtatcaattttttcatcaggaaacgccagttgtagttgagtgaataaatatttcatttgattaaatgcttgttcttgtgcggtgatattatcagtcggttcaggaattgccattaaacctcgtaggcgtaagtgcggtagattttggatatgttttgccaaactcaacatttcttgaggttgaatacctgatttgctgttttcagcactgatattaatttgaattaggacatttagtggttgtttatagtgaggtcgttgttcatttagacgagtagcaattttttcacgatcaagcgtttgcatccaatcaaagttttcagcaactaattttgttttgttggattggagcggtccaataaaatgccattcaagttgaatatgttgttctgtaaaatattgaattttttcaacaccttcctgcacataattctccccaaatgctgtttgccctgcctgataagctatcagaatatcctcgaccggtttggttttactgactgctaataaggatactgtggaagaatgtctttttgcctgttcgcaatattgagatatttgtcggtttattttcgctaaattgttttttatttgcatcataatgagcaagacctgttgaagttggtttgatatgggcattattttaccttaattattcgacagggggaaatttatgaaaaatttttcattttctatttgacaatagcataaaatttcggtatttctaacgcactcttttttgattttgaaataaccgaatgtataaccgcactttttctattaccacgatgattattaccattaagatgattaatggcgtgggctagtgcataaaaaataggatttacaaagcccgcctcgtaaaaaagtgcgggtttttttattaacgtttttattattaaatcttcacaacatataaggaaaaattatgcgagtactcaaatttggcggcacatctttagcgaatccgcaacgctttttacaagcagcagcacttattgaaaaagcacatttagaggaacaagccgccggcgttctctctgcaccagcaaagattaccaatcatcttgtagcactttctgaaaaagccgctttaaatcaacctactgatggtcattttgatgaggctcttgagattttttataatattattaatggcttatatgcagaaaatactcattttgatcttgttggcaccaaagcattaattgagtcggagtttgcacaaattaagggattattagaaaacattcgtcaggcgggaaaagtagaagatgcggtaaaagcgacgattgactgtcgaggtgaaaaattatctattgcgatgatgaacgcttggtttgaagccaaaggatatacggttactgtgattaatccggtagagaaattattggcttatggatcttatttggaaagcagtgtggatattgcggaatcaactaaacgagttgatgcaaaatctattcctgctaaaaatattgttttgatggcaggatttacagctggaaatgacaaaggcgaattagttttattgggtcgtaacggttctgattattcggcagcgtgtttggctgcttgtttaggtgcaagtgtttgtgaaatttggacggatgtagatggtgtttatacctgtgatcctcgtttagtccctgatgctcggttactttccagtttatcttatcgtgaagcaatggagctttcttattttggggctaaagttattcaccctcgcactattggtcctttagttgagccgcaaattccttgtttgataaaaaatacgggtaaccctgaaggtgcaggatcaattattgacaatcgtgaaaatatttctgaagggctacaggttaaaggcattactaatttagataatgttgctatgttcaatgtatcaggaccgggtatgcaggggatggttggtatggcagcgcgtgttttttccgccatgtcaaaagccagcgtttccgttattttaatcacgcaatcttcttctgaatatagtattagtttttgcgtaccgactaaagctattgaaaaggcaaaagcggcactaaatgctgagtttgaacaggaacttgtcgctaaagatcttgatcctgtggaagtaattcatgatttgtcaattatttccgtagtaggtgatggtatggagcggtctaaagggattgccgctagtttcttttcggcgttagctagtgctaatatcagtattgttgctattgcacaaggctcttccgagcgttcgatttcagcggttgttcctttgaataaggcgattgaagcggttaaagcaactcatcaggcattgttcaataatcgtaaagttgttgatatgtttttagtcggtgttggtggggtcggtggtgaacttattgaacaaattaaacggcaaagtgaatatttggcaaaaaaagatattgagattcgtgtttgtgcgttggctaattcgaataaaatgttgttaaatgaaaatgggttaaatcttgataattggcgtgaagatttggcaaatgcaacgcaaccgtcagattttgatgtattgctttctttcattaaattacatcatgtggttaaccctgtttttgtggattgcacaaccgctgaaagtgtagcaggattatatgaaagagctttgaaagaaggctttcatgtgattacaccgaacaaaaaagccaatacccgtgagctggattactataaccaagtgcgtgaaaatgcacgtaaaaatcatcgtaaattcctttacgatactaacgttggtgcaggattgcctgtgattgataacttacaaaatctattagccgccggcgatgatgtagtgagttttaacggtattttgtcaggatctctctctttcattttcggtaagttggaggaggggctttctctttcagaagctaccgcacttgctcgtgaaaaaggctttacagaaccggatccgagggatgatttatcagggcaagatgtggctcgtaaattattgattttggcacgtgaaatcggtttagaacttgagttgtcggatattgaggtagagggcgttttaccacaaggtttctcagagggaaaatcagcagatgaatttatggcgatgttgccttcattggacgaagaatttgcagaacgtgttgcaaaagcaaaatcggaaggcaaagtattgcgttatgtaggacaaattgaagaaggcaaatgtaaggtttctattgttgcagttgatggagatgcaccgttatataaagtgaagaacggtgaaaatgcgttagctttttatactcgctattatcagccgattcctttgttattgcgtggttatggtgctggtaatgcggtaacggctgccggaatttttgccgatattttaagaaccttaaaacattaattggagtgataaatgttaagaatttatgcacctgcatcaagtgcaaatattagtgttggatttgatacattaggggttgcagtatctcctattgatggttcactgttaggtgatgtcgttcagattgaagaaattgaacagggatttgaactggaaagtgcggggtattttgtgcgtaaattgccaaaagaaccgcaaaaaaacattgtttatcaagcctatgtgttatttagtgaacgtttaaaattacgcaatctgaaaataaagccgttgcgtttaacgttagagaaaaatatgcctattggctcgggattgggatcaagtgcttgttctatcgtggctgctttagtggcgttaaatcaattttatcagcagccattttctaaaatggaattgctggaaatgatgggcgaactagaggggcgaatttcgggttctatacactatgacaacgttgccccctgttatctgggaggcgtgcaattgatggtgcaatctctaggtaatatttgtcagcaattacctttttttgatcattggtattgggtattggcttatccgggaattgaagtttcaacggcagaagctagagcaattttaccgaaaagctatactcggcaagatgtgatttctcatggtcgccatttagggagttttgtacacgcttgtcatactcggcaggaagcattggcggcctatatgatgagagatgttattgcagaaccttatcgtgaagcattattgccgaattttgctgaggttaaacaggcagtgaaggatttgggcgtacttgcttcaggcatatccggttcgggtccaactatgtttgcgattgctccggatttagctattgcgactaaatcggcaacttatttagaaaacaattatttacaaaataatgagggctttgtgcatatctgtaaagtggataatgtgggtgcaagggctttagtttaacgagaacaagttatgaatttatataatattaaacatccggaacaacaagtaagtttttcacaagctgtgcgtcaaggtttaggaaaagatcagggcttattttttcctgaaaaattaccgcactttgacgacattgatagccttttatctttgcctttggttgaacgcagtcaaaagattttaactgctttaattggtgcggaattgtcacaagaaactattagtgcaatggtaaaaaatgcctttacatttccggcaccgatggtcaaagtagaagataatatctatgccttagaattattccacggccccacgttagcttttaaagactttggaggacgttttatggcacaagccttagcggttgtgcgtggcgacagtaaaattactattttaactgctacttctggcgataccggtgctgcggttgcacatgctttctatggcttagaaaatattgaggtagtgattttatatccaaaaggtaaaataagtccgttacaagaaaaattattttgtacacttggcgggaatattcgaactgttgcgataaacggtgattttgatgcttgtcaagcattggtgaaacaagcctttgatgatgaagaacttcgtcaagctgttggtttaaactctgcgaattcgattaatatcagtcgcttgttggcacaagtttgttattattttgaggcggttgcacagttaccgaaagaaatccgtcaagacattgttatttctgtgccgagcggtaatttcggtaacttaacagcgggattaattgccaaaactttaggcttaccaatcaaacgctttattgcggcaaccaatgccaatgataccgttcctcgctatttgaatagcggaaaatggcagcctcatacaacagttgcgactctttccaatgcaatggatgtgagccaaccgaataactggtctcgtgtagaagaattatttaaatgtaacggctggtctttaagtgaattgggttcaggtgcattgagtgatgaggaaacagaaaaaaccttgcaggcacaatatgccaaaggttatttatgcgaaccgcatggggctattgcgtatcaggtgctaaaaaatcaattacaggttaatgaaacgggtattttcctttgtacggcacatccggcaaaattcaaggaaaacgttgagcgtattttaagtctcgagcttgtgcttccagaaacattggataggtacaacaaattgccattgctttctgatgaaatggaaaatgacttcgctcaattacgtgcttatttattaaaaaaataaagcattttaaattaaaagtgcggttgaaagtcggaaagtttcgattttatgtacatataataaaagagtgggattcccactcttttgtttgctgtactgtttttttagacaagaaaaacttttaattcgggagcttatgcctcttattttcttgatagacttgcttgaattttattttttgccactttcatcacagttttgtacattgctacattttccgtaaagatacagattgtgtgtttttaatttgatgccatgttccgcactgatttcacgttggcgtttttcgataacttcatcattaaattcaaacactttgccacaatcgacacaaataatgtgatcatgatgttcttccggtgctaattcaaaaacagatttgttaccttcaaagttatggcgaataagaatatttgcctcatcaaattggttaagtacacgataaacagtggctaaaccaatatctttaccttgttccagcaacattttatagacatcttcggcggagaaatgttgcattgtgcctctactttcttgcattagagacaaaattgttaagcgtggttctgtaatttttaaacctgctttttttagtagcttgatattttcttcagacatggtagctcctcaaattttatgccagctcagctaaacacatttcgtcatacacttgtttaacccatttttctacacgttctgcggtgagttctggttgacgatcttcatcaatacataaacctacgaatgtattgtcatcaactaaggcttgcgagacctcaaaagtataaccttcggtcggccaatgcccaacgataattgcacctttgggttcgataatattgcgtaccgtacccatcgcatcacagaaatactctgcatagtcttcttgatccccacaaccaaaaatagcgactaatttatcggtaaaatcaatttcttctaaggttggaaagaaatcgtcccagtcacattgggcttctccataataccaagttgggataccgatcattaaaaaatcatagctttcaatgtcttctttactacttttagcaatatcacgaatatcaatgagttccgaacctaattgtttttgtatcattttagcgatattttcagtattacccgtatcactaccataaaataaaccgacaatagccatttttatctatttccttgaattttaaaataatcttttaagatcgttataattaactctcaatgactaatcgcttgttcagacgcctgacttctaactgctgaactaaatccgcatgtaacttttactcaatacgttttaaaatgctaaatttatcgcattgaagttgattacatttgtttattcggagctgttgttcatgaagcagtgaatttgttctaggcgtcctactttgggaagcgtcgcaaacagatttagtgtaatacaatctgcatcttgtttagccgttttcaaaccactgaaaatatatcaattctagcctggttctaattgagaatgataagctacaagcaaaatttgaagcgaactataacacaatttataagtgaattaaaccctatagatcaagtaaacatgagaatttttatgacaaaaaacgctgaattgatctaatcacaaaatccgctttttcagcatgtacccaatgcccacttccattgattgtaaaagaggtcgcttgtggaaattgagcgagaatttgttcactgtattccggcaaaatgtaattcgataatccacctcggataaacagtgttggtttgtcaaaaaatcctttttcccaattcataatattggcgtaattttgtttaagtgcggtgagattaaagcgaaatttttcttttgcttgtgcatcgaaagacttgagcataaattgctgtacgctttcttgtggaatatagttagccagtaattgttttgcttgttgacgagtttccgattgtgctttacttacggcaaaaagtcccgcaaatacactgtcatgctcattgttaccgtaattaaccggtgcaatatcaatcacgatgagtttttctattaagtgcggtcgtagcattgcacatttcatcgctgtttttccacccatagaatgcccaattaaaataacgttggttaaattcaaatgagcaatgacttgtagaacatcttccgccatcagctgatagttcatttcttcactatgaaaactttgtccatgattacgtaaatcaagacgtaaaatagggtatttttcggaaaaagcacgagcaatgacaccaagattattcatatcaccaaataaaccgtgaatgaaaacaagagtgggggagatttgcgagttgtttatggcgttaaattggtaattgagtaatttagtcgtgggcataatttttgcgtgtgtatttgtaaagaaatcgttataatgtgcgaaaaattcaaatagatcaagtagaaatctcttgtaggcttgtaatgtaaaaggagttcggttatgaaaattattgaagttgacgaagagctttatcagtatattgccggtcaaacgaagtctatcggtgaaagtgcgtctgatattttacgccgtttgttaaatcttccttattctaacgtagcaagtgcggtacaaaattcggaaaatgtatctacagaagcgattttaccaaacacttgtatagaaagcgaacaggaagttcaaacgaacgaattaataaatattcctgtcaaaaagcagtctgatgaagctattcagaaaattgttgataaagtaagaaatcttttatattcagaagaattccagcaagaaacgaaagctgttgtgcgttttttgagcttgttgcgtacactttaccgcactaatccggaaagttttgcattggcaacggaaagtttgcaaggtcgcacaagagtttatttcgcacgtgatgaggctactttactggtagcgggtaaccatacaaaaccgaaacaaattcccgacactccgttttgggtgatcactaatactaatagcggtcgaaaaatgttgatgttggaaagtgcgatgcaatctatgcatttaccacaagaacttattgaagaagttagatctttttttgtgacgaattagcgatgttcttttggcataaatatgcactcactcccttatttcaatcaaaaatagccttgcgaaactcgcaaggtgaagtctttacttggcaacaactttgttctttaatcaatcggcaatctctactttttcagcaacaaggtgttaaagcaggttcgggcgtgttgttatgtggtaaaaatgatttttcattattgttggcttatttggcaacaattcagttgggagcaagagttttaggtgttaatccgagttttcctgccgataaaattcagcatatcgcagaatgttatcaatgtgattttatttttaataggactgctttcctgtttaaaaatatgcaaaatttgaccgcactttctgtgagcgactgtacgcaatatgtagatgttttacctgaaactgaagttaaaatggatttgcaggctgtggcaactttaactttaacttcaggatcaagtggtttaccgaaggcggttgtacatagtttgcaggggcatttagataatgcgattggcgtttgtgagttaacccaattcagtgcaaaaaacagttggcttttatctttgcctttatttcatgtttccggacaggggattatttggcgttggttggtaagcggtgcagaattgcatttaccgcaagaggatttttatttttctgttagtcaggcaagtcattgttcgttagtaccgacgcaacttcaacgtttattcgattattggcaacaaaatcctactctcccacgttacacacagcatattttgttaggcggtacgcaaattcctacgcagttgactgagaagttggcacaatacagtataaaaagttacaccggctacggtatgacagaaatggcttcaacggtttgtgcaaaattgagtgatggtaaacgtggagtagggcagccgttagcggggcgtgaagtgcggttagtttgtgatgagatttgggtacgaggtgccggtcttgctttgggttattggcaacaaggtaaaatttgttctttactgaatgaacagggttggtttgccacaaaagataaaggtatttggcaagataatgaattgcacattttaggacgcttagataatatgtttatctccggtggggaaaatattcaaccggaagaaattgaacaaattattggacagaatgaaacggttgcacaggtttttgtattgcccattgatgatgttgaattcggacaaagaccggtggcaatgattaaatttcacgatgttttttctgaacaggcagtacatgaattacatatttggttagcggataaattggaaaagtttaagcaacctattcaatattttccattgctgttgcaatcacaaggaaatatcaaaatttctcgtcatcagttaaagtctgagctaactcgtttattaggaaagtaagtatgaagaagataaaaaataaattcaaacaagttgtcatgattggcttattctctttagctcagtttgcactggcaggagcaattttgaccgaaaatgatgtaaagatgcgacttgatgagattaaaaaaatcgaacacccccagcaagaagataaaagtgcggtgcaaaacttggaagaaacattgtttctcttaggaaaaatagcaaaacagaaagaagacaatctaaagttacaaaaactgattcaagatgcaccaaatgagcaaaagaacatcagagaggaaatcactacattaaaagaggcgtttgttgttcgtgattttgataatttgtccatcgagcaattagaggataacttagcaaagatacaatccgaattacaacaagttcaagctgatttagtacaagctaatgcacagttagttaatcaacattctgcaacagagcgggcacaaagtgcgttaagtgccaatattgttcgtacacaagaaattgataaattgtcttttagtgttgatattgcacctgaggagcaaaataaattagctacagaaagtgcgttaattgaattacaaaatgactacaatcaaactgtattacaagggaataatgaactcaccgcactttatactttgcaattggaattgaaaaatcttgtccaacagcatttacaagctacgcaaactgcgttacagacagaaattaatcgacgtaaattagtgcaaactgagcaacatgtggagcaactaaaacaaactcaaaaggaagcagagggtaatccgttattagttcagcaacaacaaattaatattcagattggacaagatttagtggaacaaacaactaagctgaacgctttgtcgcaagacaatttgcgtattaaatctgttttggataatttgcaacaaactgaacgtaatattaatgaacaaattagtgctttacagggaactttagttttatctcgaattattaataagcaaaagcaattattaccgcacgataggatgattacaggattatcaaatcaaattgccgatttacgtgtgaaaattttcgatttaacggagttaagagatagcctttatgatattgacggttatatttccaatatagaaagaaagcaaggggttacttttggaatagctgaacacgcacagctcagcaaaattttacgggagcgtcagaagggtatttctgatttggtgtctattttaaatgatcaactcaatctttcaatcaatattgaattaaatcaaaaacaagtcaatttaattagtgatactttacaagaaaaactccaacaacaaagtttctgggttaagagtaatacacctattgatttggattgggttaagcattttccttcactactaaaaatagaattggaggatattcgtacgcaatttaatttcaacaattggcaagataatattatttctgccactgcgttaattgttttccttttatccatcgccttttttatttcttggcgtaaagaaaaaattaagcaacggttgaattatattaatagcaaaattaatacgttacaggaagatagacagctttacactccggaagctgttttttggacgattattctttgtttaccgatgacgttagttgtcttagtcggtttaattgttattacttttatttgttttaatgatcctgaaaaattctggttgtggtcagtaagaatgtcgggttattggtggcttttcgcttttatgttagcgatgttacgcccaaatggccttgcttatcgtcattttagtatgcctaaatataatgtagagcttttttccaatgtgatgaaacgatcagtatggattactgttctttggcttaatgcctctatgtttacttatttagatggaggaattgctaatgatgtgattggtcaattgatgacaattgcggtcttagttatttcactgtttattattggacctcgtatgcgttatgcagtccaagcttatgaaaaaaactcagaaaaaaaacctttcctaaaagttttccgtattgtgttgctactctctcctattattctcattgtgttggtagttttaggttattactacactacgttaaatttgatggatcatttgatgtcttcttattttgctttgatgatatggatagtaattcgcaatatagtgtatagaggatttactatttctgctcgtcgtttagcttatcgtcgtttgcaagaaaaacaaaagaaaacacaggtacaatctcaagatgtggtggataaagaagagtttaaccttaatacacaagaggaagttttagcaatttcagccgttaaggatcaagttttgcgagtgatggatttagttttactcgtcggcttaatcggtatgttctattgggtttggtctgatttaattacggtagcttattatttggaaggcgtaacgttatggaaacaaactgccataacagaagttggtacagttattgaaactattaccctgtggaatttgttattagcactgattattttaggcatcacgtatgctttagtgcgaaatattggtggggtattggaagtattaattttttcaagagttaatttctcacaaggaacaccttacaccataacaactttactgatttattttatcattgcaatcggtagtgctatggcattctctactttgggtatgtcatggtcaaaattacaatggttatttgccgcactttctgttggtttaggttttggtttacaggagatctttgctaactttgtatcaggtatcattattttatttgaacgtcctgttcggattggtgattttgtaacaattgacaatttttcaggaactgtgtcaaaaattagaattcgttccacaacaattatcgattctgataagaaagaagttattgtacccaataaagcctttgtaacagagcgaattgtgaattgggcattgaccaattctatgactcgtgttgtgattggtgtcggtgtggcttacggttcagatttagaattggttcgtaagttgttgttgcaggcagcgtatgaaacacctacggttttaaaagaaccggaaccgtctgcttattttatagcgtttggtgcaagtacattagatcacgaattgcgggtttatgtgggtaaattgtcagatcgtatgactacacaagactttttaaatcgtcgtattaatgaactatttgcacaacataatattgaaattgcatttaatcagttggatgtatttattaaaaatcaaacaacaaatgaagaagtaaaagtactttcagagaatttacaaagataaaaggaataaaaaaatatggcgggaaatagtattgggcaacttttcagggtaacgacatttggagaatcccatggtattgcgttgggctgcattgtagacggtatgccgcccggacttgctttatccgaagatgatattcagccggatttggaccgtcgtaaaccgggaacttcaaaatatactacgccacgccgtgaagaggataaagtacaaattttgtccggtgtgtttgacggaaaaaccacaggaacaagtatcggtatgataattaaaaataccgaccaacgttcgcaagactatggtgaaataaaagatcgttttcgtccggggcatgctgattttacttaccagcaaaaatatggtttacgtgattaccgtggcggagggcgatcttctgcacgtgaaacagtgatgcgtgtagctgcgggggcaattgctaaaaaatatttgcgtgagtattttggtattgaagtacgaggttatttatcacaaatcggtgagataaaaattgatccgcaagtggtagccgatgtgagtaaaattgattgggcgaaagtaaatagcaatccatttttttgtcccgatgaaagtgcggtggaaaaatttgatgaattgatccgagaattgaaaaaggcaggaaattctattggggcgaaattaactattgttgctgaacatgtgcctgtcggtttaggcgagcctgtttttgatcgtttagatgcggatttagctcatgctctcatgggaattaatgcggtaaaggcggtcgaaattggtgacggttttgcagttgttgaacaaaaaggaacggaacatcgtgatgaaatgacaccggaggggttttgttccaaccatgccggcggtattttgggcgggattagctctgggcaaccgattatcgctaccattgcgttaaagcctacttcgagtattaccgttgtagggcgttcagtgaatttaaataatgagcctgttgacgtgattactaagggacggcatgatccttgtgtgggaataagagctgttccaattgctgaggcgatgatggctattgttttattggatcatttattacgctttaaagcacaatgtaaatagaacacataactatgttaagaaaggtaaagttaatgctgaaaactgcggttttttttaccgcactttttttcactcagatattaagtgccaatccacaatattggcaatcagtgaaacgacctattcatggtgaggcaatgcctataggaagttataataatggctgtcttattggtgcggaagcattgccctttaatggcgagggatatcaagttattcgtactaataaaaatcgttattatggacatcccgatatgattgcttatttgcaacgtctcggtaaaaaagcaaaacaggaaggtcttccaacgattttaatcggtgatattgctatgccgggaggaggacgatttttaacaggacatgccagtcatcaaatgggacttgatgcagatatttggttgcgtttaggtaaactttcggctaaagatgcacaagatccaagtggaatgggactgttggttgttgaccgaaaaaaacagagagtcattgataaattgtggtcaaaagatcatgaaaatctgattcgtttagctgctcaagatctacaggtcagccgaatttttgtaaatcctgcgattaagttgaaattatgccaaacagtaaaaggtgatagaaattggctacaaaaaattcgcccttggtttgggcatgatagtcatttccatgtgcgtttaacttgtccaaaagatgctaaatactgtgaaaatcaattgccaattccagcgggagagggatgcggtgaagaactttattcttggtttaaacctgctaaaccaagtgaatttaagcccaaaaaagtggtgccggaagccccttttctttgtcaacagttaataagtgcaccaaatcgtcatgagtggttagaataggaataatatgatagtagaaattactcttcaactaatgttaattttgtttttggtcgctatgatagccggctttatcgatgccatggcaggtggtggcggtttgattactattcctgcactattgatgactggtatggcgccggcattggcacttggtacgaataaattacaggcttgtggcggttctttttctgcaagtttatattttttacgcaaaagagcggtagatttgcgtgcttttttgttgattattgtcatgacttttttgggggctgcattaggcactttatctatccaaagtgttgatgcaatcttaattaagaaagttttgcctttcttggttttgattattggcttatattttttattgactccatcacttggtaataaggatagacaaccccgtatttcttatagtttatttgcattcagtatcggtctgacagttggtttttatgatggtttttttggtcccggaacaggctctttactgactcttgcttgtgtaagtttactcggttttaatttagcaaaagcaacggcacatgcaaaagtgttaaattttacttcgaatattgcatcattgctttttttcttacttggagaccaaattttttggaagttgggcttggtcatgatgcttgggcaatttattggtgctaatttaggcgctaaaatggtattaacaaaaggaaaaaccttaattcgtcctatggttgtattaatgtcttttattatgacggttaaaatggcttatgagcaagcttggtttagctggtaaaccgatgaattattggagtaaacatgacagaaaataatgatttacgtttaaccgcacgggtcggatatcaacctcattactcttggttctatttattgcctaaatattggggtatttggctcggtatttttgctttattaattttagcttttgttccttttcgctggcgagataaattggcgacaaaattgggtagaattatcgctcgtaaagcgaagaaacagagacatcgtgctgatgtcaatttgcgttattgttttccgcattggtcagaaaaacagcgtaatgaagtgattgaaaatatgtttattactgttactcaagtgatgcttgggatcggtgaaattgcattacgttcaaaaaaacacctgaaaaaacgtagtgagtttaaagggttagagcatgttcagcaggcaagagcggtaggaaaaaatattattttaatggtgccacatggttgggcaattgatgcgtcggggatcattttacatgcacaaggaatagcgatgacttctatgtataacccacatcaaaaccctcttgtggattggttatggacgatgactcgtcagcggttcggtggaaaaatgcatgctcgtcaaaatggaattaagccttttcttaatcatgtaaagaaaggtgaaatgggctactatttacctgatgaagattatggtgaggaattgagtgtttacgctgatttttttgctacttataaagccactttgccgggattaaataaaatggcaaggttggcaaaagctgttgttattccgatgtttccacgttataacgcacaacgtgggaagtatgaaatagaaatttgtgcacctttagaattaacggaagatccagaacaatcggcgagaatgatgaatcaagcaatcgaatactttgttactccaacaccggagcaatatgtctggattttacgcttattaaaaacccgcaaagataatgaagatatttatcgttagcttgggcaatttgtgctaaactttgtgccgttttgttgaataaacttttctcatagaatcagggaataaaatgaataaattagaattgattaaatcctctattaaatctattccaaatcaccccaaagaaggaattattttccgtgatattaccagccttactgaagtacctgaggcatttcaagcaacaattgacttaattattgagcgatataaaagtaaaggaattactaaagtgatcggtactgagagccggggatttatttttggggcgcctgttgctttggcgttaaatgttccctttattttggtacgcaaaccgggcaaattacctcgtgaaactatcgcacaatcttaccagttggaatatgggcaagatactttagaaatgcatgtaagttctattcaagccggtgataatgtacttgtgattgatgatttattagcaactggtggaactattgaagcgactgtaaaactggtagagcgtttacaaggtcaagttaagcatgccgcctttgttattagtttgccggatctcggtggtgaggttcgtttacgtgaacttggtgtggagccatttactttagtcgaattttcaggtcattaatttcttcaaattaatagagatagataggcaatgagttatcaagtattagcaaggaaatggcgtcctaaaactttttctgaggttgtgggtcaagagcatattttgaccgcactttctaatgggttatgcgaaaatcgcttgcaccatgcctatttgttttctggcactagaggcgttggaaaaacttctattgcacgtttatttgccaaaggtctgaattgtattaggggggttacggcagaaccttgtggtgaatgtgagcattgcaaggctattgaggaaggtcgttttattgatttaattgaaattgatgctgcttcacgaactaaagtagaagacaccagagagttgcttgataacgtgcaatataagcctactcaaggtcgctataaagtttatctgatagatgaagtgcatatgctttctcgtcattcttttaatgcgttgttgaagacgctggaagaaccgcctgaatacgtaaaatttttattggcaacaacagatccgcaaaagttaccgattacgatcctctcacgttgcatgcaatttcatctaaaagctttatcagaaaaacaaattgcacagcatttagaatttattttacaacaagaaaatattccttttgaatatcctgctttggaaaaattggcaacagctgcacaaggtagtattcgagacagtttaagtttaactgaccaagctattgctatgggcaacgctaatgtaagtttggatacagtaagtatcatgctgggcttattggatgacaatcagcctattgatattttatatgcgttacagcaaggcaatggtgaaatgttaatgaaggcaattcaagctgtagcggaaaaaggtgctgattgggataagttactggtaactttagcggaaaaattgcatcaaattgccatgctacaacttctgccacagcaaataaatgaagaaaactcgcttggatttttagctaaacatattacgccggaagatgtacagtttttttatcaggttattgttagcgggcgtaaagaattagcatctgcccccaatcatcgtattggtgccgagatgattttgttgcgatccttagcgtttcaccctaagttcattagtccttcttcagcagcaccaatagaacaaagtgcggtgcaaaaatcacaaaatattgttcaaccgcctttagttgagatgcccgttgtttctgttgccgagcaattaccttcgcaaaatctcattcgtaaaccaacgatagcagataaggtcgatactaagttaagtacaacagctttaagtgctttagaagcgttagaacagttgtcacaacctagtgatcattcagatagcgaaaaaaaaaactcgccgatagataatattcatgatatttctttaagagaaaacactgaaaatatctccgcacttcctgttctaaatgttgtgcctaaagatgttgataatgcacttaagacggttactgtcattgataagagtgatcatagaagtgatgaaattcaagaggatagtgctgagaattatcgttgggaatggcgaaatccggaaatggcggttgaggaaaaggctattcgtccttctgaaataaagcaagctattttagaacaagcttctccggagctcatacaacgtataattgctacggcacaagaaagagatgattggactcggatcattgagcaattacctttgagaggtatgacaaaagacatggcgttaaataccgttctattaaatcaatcgggggatcagatcgttttatccttaatgtctgataaacagcatttgttagatcgttgtcataaagaattaaagcaagcattatcggatttctatcaacgtgatattcagttattaatcacacctactgacgataaaaatttagccactcctttatattatcaaaacttagtttatcaagagtttaatgagcaagctaaaaaagcgttacaagaagataacagcctaaaattattagaaaaagaatttgccgctacgctggatttggatagtgttagaccgatttgacatttttactacgatttagatattgtcttgagctttgagcaatgattatataatgatgaaaaaagctaaaaatcgaccgcactttttctttatttgcgatccggatcgcataaatgttttttgatgacaaattctcttttcccaaatacaagaaaattgctagattaatcctattgaacaaagtacaatctccgcctctttttgatcatcaatgaatgccataaggtgtaataacggggcaataaataataaatgtcggacaaaattaatttaatgaatttaactcgtcagcaaatgcgagcattttttcaggagttaggtgaaaaaccttttcgagcagatcagttagttaaatggatttaccattttggtgaagataatttcgatcatatgactaacattaataaaaaattacgtgaaaaattaaaaactgttgctgaaattaaagctccggaaattgcagttgagcaacgttcagctgacggtacgatcaaatgggcaatgcaagtaggagatcagcaggtagaaaccgtttatattcccgaaacggatcgtgctacgttatgtgtatcttcacaagtagggtgtgcattagcttgtactttttgttcaacggctcaacaaggttttaaccgcaatttaactgtatctgaaattattggacaggtttggcgagcttcaaaaattatcggtaatttcggtgttaccggtgttcgtcctattacaaatgtggtcatgatgggaatgggagagccattattgaatgtagctaacgttgtaccggcaatggaaattatgttggacgattttgcttatggtttatctaagcgtcgagtgactttatccacttccggtgttgttccggcactagacaaactgagtgaaatgattgatgtggcattggctatttctttgcatgcaccgaatgatgaattgcgtaatgaaatcgtgcctattaataaaaaatataatattaaaatgttgatggagagtgttaatcgctatttaaatgtttccaatgcaaatcacggtaaggtaaccattgagtatgttatgttagatcatattaacgatgggactgaacatgcacatcaattggcagaggttttgaaaaatacaccgtgcaaaattaatttaattccttggaacccgtttccggatgcaccttatgctaaaagctcaaatacacgtatagatcgttttcaaaaaactttgatggagtatggttttacagttattttacgcaaaacaagaggtgatgatattgatgcggcatgtggtcaacttgctggtgatgtgatagatagaacaaagcgtacggcacagaaaaaacggtttggaaaagaaatcggcactcatcaaatttattaactatttttaatgtataaggagagaaaactaatgcgatatcggactatatttacttttattatattctctctttttctttctgcttgcgtttctcagcctataactgttcgctttaataagcaacaagctgcaaaagcacgaattgagttaggtttaggttatttaaaattacgcaatttttctcaagcaaaacttaattttgataaagctttattctatcaacctgactattatttggtacattcggcttttgcctatttatatcaattgcaaggtgatatttcgcaagcgaaatcctcttatgaaaaagctatcagtttggataagtcgcaaggtgatgtgaaaaataattatggtgcatttttatgtagtcagggcgaatttgctcgtgcttatgagttattcgagcaggcacttactacgcctaattattatcagcaagcggatacctatgcaaatatcataatttgtgcagaggcggaacataatattccacgttatcagaaatttttacagttactgaagaatattgatcccaaaagagcggaggaaataaagaaagtttcttagcttagttagcgtgagttgaaagatcaaaaatggcaagactgtcttcttgccatttttattatattatgattttttgatgtaattagattttacaagctcctcctgcacaagcgtcatcaagatcttcttgcatatcttctgcaccatctctagtgttttgataatacagggtttttaatccatatttgtaagcagttagtaaatcttttaataaaaccttcattggtactttaccatcttcaaaacgttttggatcatagttagtattcgctgaaattgcttggtcaatgaatttttgcatgataccaactaagtgtaggtatccatcattacttggaatatcccacagtaactcatagttttcacctaaattctcataatcaggaacaacttgctttaaaattccatcttttgacgctttaatactaacatgtccacggggaggctcaattccattggttgcattagaaatttgagaagaggtttctgatggcattaatgcagttaatgttgaattacgtaaaccaaattcttgaatttctttacgcaaggcttcccaatcgtaatgtaaaggctcttttgttaagttatcaatatcttttttgtaagtgtcaataggtaagatcccttgtgcataagtggtttcatggaagtattcgcaagcaccgatttcttttgccaaattcattgaagcttttaataagtaatattgaatagcttcgaaagtgcggtgtgttaaatcattcgctgaaccatcggagtaacgaacattattttttgctaaataataagcatagttgataacaccgataccaagagagcgacgagctaatgaactgcgttttgctgcagcaacagggtagtcttgatagtctaatagggcatctaatgctctgactgcaagatcggctaattcttccaactcgtctaaattttcaagagcacctaagttaaatgcagataatgtgcatagtgcaatttcaccgttttcatcatggaaatgttgcaacggtttggttggcaaggcaatttccaagcataaattagattggcgaattggtgcaaccgcaggatcaaatggcgaatgtgtgttgcaatgatccacattttgaatataaatacgaccggttgacgctcgttcttgcattaataaagaaaatagctcaacggctttgacactgcgtttacgaacagcgggatcttgttcatatttgagataaagcatttcaaatttattttggtcagcaaaaaatgcttcgtataaccctggaacatctgatgggctaaatagagtaatttcaccccctttaattaagcgttgatacatgagcttattgagttgaactccatagtccatatggcgaacacgattgtcttcaacccctcggttattttttaataccaataaactttcaacttctaagtgccaaattggataatagacagttgccgctcctccacgaacaccgccttgtgagcaagattttaccgcagtttggaaatgtttatagaatggaatgcaaccggtatggaatgcttctccattacgaatcggactgcctaaagcacgaatagcaccggcattaactccaatgcctgcacgttgagaaacgtatttcacgatggctgatgctgttgcattgattgagtcaagactatcaccgcactcaattagtacacaagaactgaactgacgagtcggggtacgcacacctgccataattggcgtaggcaaagagattttaaaggttgacgtagcatcatagaagcgatgaatgtagtccagacgagtttcttttggatatcttgaaaagagacttgcagcgactaacaaatataagaattgtgcagactcatagatttcacctgttactctattttgtacaagatattttccttccagttgtttcacagcagcataggagaatgtcatatcacgccagtgatcaaggaaaccatccatttcatcccattcttcacgtgtataatctgttaataacgcctgatcatattttcccatccgcacaagtttttttacatgatcataaagttttggcggctcgaaatgtccataggcttttttacgtaaatggaacactgctaaacgagcagctaaatattgatagtcaggactatctttactgataagatctgcggcggctttaataatagtttcatgaatatccgaagtgcgaattccttcataaaattgaatatgcgattttaattcgactaaggaaacagaaacattttccagtccttccgccgcccaagtaatgactctgtggattttatctaaatcaataggttctttgtttccgtcacgttttgtgaccatcaatgctttattcataggatttccgagaggttctgatatggttaaaacacaagatatagttataaatcaaaaatggactacaagataatgggttggatggaaaaattcaagtaataaatttcatctatgattcttgacagaaaataacttacttataaataagtaaaaaatgaaaaagtaataaaaactattatcaaaaattgtgctgtagatcaaaatttatattttttgatatgaataaaatgatctttattcttagagataataaaaaagytgytcaamgaacagctttcaagggttattttcctaaattatcaaagaatttttttactccatctaaaaaacctgaggatttagggcgttggagcgttttaccttctaaactttcttccaattttcttagtaactctttttgttcttcgtttagtttaattggtgtttcaataacgatctcgcagattaaatcgccagcatagccgcgagaggtaatgccttttcctcttagacgaagcagtttaccggtttgtgtttcagcaggaattttaactttaagacgaccgtctaaagttggaatttctatttcgccacctaatgcagccatagtaaagctgatagggacttcacaataaagattgttaccatcacgttcaaaaatatggtgtttttttacatggataaccacatataaatcaccggcaggtgcaccattttcacccgctgcacctttacctgctaaacgtaattgattacctgtatctacgcccattggaatggtaacggtaagattttgggttttatgaactctaccttcaccgtgacaggtatgacaaggtttctctatttttttgccagtaccgtgacagtgtggacaagtttgttctgtaacaaagaaactttgttggcgacgaacacgacctgcaccatgacaggttggacaagattcaatttttgaacccgcttccgcacctgagccatgacaagttccacagtgaacaagagtgttaatttgaatatcttttttacagccttttaccgcttcttccaaacttatttcaatatcgtagcgtaaatcctcaccacgaacaacacgttgacgagaacgtccgccaccaaaaatatcgccgaacatatcgccgaaaatatcaccaaagtcagctccgctaaagccgccgaaaccgccggcaccaccactttgttcaaaagcggcatgaccatattggtcatacattgcccttttctctttatcagccaaaacttcgtatgcttcattaatttctttgaatttttcttcgctttctttatcacctttagttcgatccgggtgatatttcatcgcaaggcgtttgtaagcacgtttgatttctttatcatccgctcctttttgaacacctaatatttcataataatctcgttttgccatgtgtaatccggttagttgttgcgttataaacgctgatagtcatacgttgaaagggcgtattactacgcccttgattctgattagtgagatatacagattatttatcttttacttcttcaaattcagcatcaacaacatcctctccacctttcgtactttgagattgttgtgcaccagcatcagcttgtgcttgttgttgacttgcttgaagtagtttttcggaaacttgaattaatgcttgtactttggcatcaatttcagttttatcttcaccttttgccgcagtttcaagttcattgaccgcactttcaattggtgctttgtcttcagctgataatttctctccaacttctgctaattgtttgcgggtactatgtactaagtgatccgcttggttacgagcttgaactaactcttcaaatttacgatccgcttccgcattagcttccgcatcacgaaccatttgttgaatttcttcatcacttaaacctgaagatgctttaatcgtaattttttgttctttaccagtacctttatcttttgctgaaacatggataataccatctgcatcaatatcaaaggttacttcaatttgaggcataccacgtggtgcagggttaataccttcaagattaaattgacctaaagacttattggcagaggcttgtttacgttccccttgaagtacgtgaatagtcaccgcactttgattatcttcagcggttgaaaatacttgcgattttttcgtcggaattgttgtatttttctcaatcaaagttgtcatcacgccgcccattgtttcaataccgagtgataatggtgttacgtctaacaataaaacatctttaacatcaccggccaaaacaccgccttgtacagctgcaccaatagcaaccgcttcatctgggttaacgtctctgcgaggctctttaccaaagaattcagctactttctgttgtactaacggcatacgggtttgtccgcccactaaaataacatcattgatttcggaaacgcttagacctgcatcggaaagtgcaactttcacaggctccattgaacgtgcaactaaatcttccactaacgcttctaatttcgcacgagtcaatttaatgtttaaatgtttaggtccagtagcatcagcagtgatataaggtaaattgacatcagtttgttgagcggaagaaagctcaatttttgctttttcaccggcttcttttaaacgttgcattgcgagcggatcgttgcgtaaatctacgccctgttcttttttgaactcatcaactaggtagttaattacacggttgtcaaagtcttccccccctaggtgagtatctccgtttgttgctaaaacttcaaacgttttttcgccaccgacttcatcgatttcgataatagataagtcaaatgtaccaccacccaagtcataaacggcaattatttggttgcctttacctttatctaaaccataagcaagagccgccgctgtcggttcgttaataatacgtttgacttcaagaccggcaatacgtccggcatcttttgttgcttggcgttgtgcgtcattaaaataagccggcactgtgattacagcttctgttactgtttcacctaaaaaatcttccgcagtttttttcatttttttcaacacttcagctgaaatttgcggaggtgccattttttcaccttttaccgatacccaagcgtcgccgttatcggctttagtgatttcaaaaggcataatagcaacgtcacgttgtacttcttgatcttcaaagcgacggccaattaaacgtttgatcgcaaataatgtatttttcgggttcgtcacagcctgacgtttcgctggttgtcctactaaggtttcattatcatttgtataagcaataatggatggggttgtgcgttcgccttcagcgttttcaatgacacgtggtttgtcgccgtccattacagccacacaagagttcgttgttcctaagtcaataccgataatttttcccataatatgttttctcctagtatctagtataaattcgttgacagtttcaagattgggataatgattgcaatttcaagtgcatggaatgcaaaattttgaaagtgcggtcattttttgccttgttccgtaaaatgtgattggaaataaaaaattcaagaggaaaaatgaaattttatgtaaattaagttaaattttgttcaataaattgctgtttttttatttgaatcgcaatttctctccgacgatccagttctactcgaattgctttatgttgaaagccttctgaaataatctgttgcacatcaacagctaaagctgcttggtagaggcacaacaaaaatttgtattgtgggcaatcggtatagctcatttcggtttgagtcagactatcagcaaggcaaactaacattaattcttcgaagcgtttttgtttacgccagacatctaacttattaaataacgttaagattgttttggtgtgcaatgccaaagcatgatgaatatgagaatgatattggcaagttaattctgccagttcttgaacatagttagggactttaaaacgctggcagacatttctgagataagcaatacttgttattttattatcatgagaataggggggaatattggcggttgagagagcttttcccacatcatgacaaagtgcagcaaaacgtaccgcacttttgtgataatccgttttttcggttaacaatgttgtttgcttaagaatgggcatagcatgcacaaaatcagtcatgtcggagcgatattgtatagagtcggaatcaaacacactaatttccggacataaaacttttagggcatctattttttgtaagatagcaaaataaacttgtggatcctgttcatgtagtgctttttctgtttcttgccatactctttccggagaaagttgtctcaactctccattattggctatttttttcattaaggctagcgtatctggtgcaattttaaagcctaattgatgataacgggcggcaaagcgagctactctgagaactcgtaagggatcttctgcaaaagccggcgaaatatgacgtaaaataccttttttcaaatcggcaataccattgtatggatcatgatattgccccgccatatcctgagcaatggcattaatggttaaatcacggcgcatcagatcttgttctaatgtaatattagggttgaaatcacaaataaaaccggtatagccggtacctgatttccgttctgttcgtgcaagtgcatattcttctcttgttttaggatttaagaaaacaggaaagtctttaccaacttgttgataaccctgagagagtaattcttcagctgttgacccaaccacaagccaatcacgatctttaatgggtaagccaagtaattgatctcgaacagcaccgccaacaagataaatttgcatcatatcgttaagaccaacgattttggcgacggcgtttcggaattagtagaggtaaaataagaccaagcaataatcctgcacctaaaacagagccaccgtagataaaccactgaatagcgatttctcgtttacccacatctaacatcgcttctaaatcacgatttttattttttgtaatttccaattccctattaaggagtgagttttgttccagtaatttgctactttgttcttctgcttgtttggtacggcgttgcatctcgcttgttcgttgtttccagtcattgtcaatattattgagctttagagttaactcttggatttgagcttttaattttggattttcttccctactacttggagtactggttaattcacttgttaaaatccatgcttcacgattacgtttgtcacgaattaaggaatatttatcttttttatccagtacggtaaccgactcgcctgcttgaatagttcccgaaattttaaattgatctcctgcacctcgtcgcataaacgttgtgagattttctttcacgtattttgtttcggcataagcgttggataaggaaaatcctaatagaagagcggatactaaaagagaggtaatttttttcataataaatccagaaaataaggtcaacaaaaaagtaataaaaagtgcggtagattttaccgcacttttttttgctgacaagtaatgatttattttatctttgagcgttaatgaaaaatcgcataaataatgtaataaatcacaatagcaaagaaagtacccgcaggtaatgtaacaatccaagaagcaacaatattacgaataacggttaagttaattgctgcaataccacgtgcaaaaccaatacctaaaatagcaccaacaagtgtttgagtcgttgatataggtaatccggttcctgatgctaagacaactgttacagcagtggcaaattgggcagcgaaaccacgacttggcgtgaggtctgtaatgcctgtcccgatcgtcgacattactttataacccataacaattaaacctactccaatgccgacagagccaagaggcaggatccaccaagccagggtagtttttcctgcaatctcaccaccatgttctatgatggaaacaacggcggacaaaggacccactgcgttggcaacgtcatttgaaccatgagcaaatgccattgcacaggcagttaatagcattaaaatactaaatactttttcaactgctccaaaggttcctttcgtaacattttgaatgaaacgttggctacgaaaataaaaagaaccaagaatacccgcaataatactaatgataccggatataatcagtgtttctatggtagttaaatgtaatccaatatgttttagccctttcgtcatagttacaatagctaaaataagaacggtcagtcccatataaaaaggtccgtatttttgggcattagctaaaggttttggcgtgtcaaagattaacttttgtgtactaaagaaaatagcgtaagcaataattccggcgagaataggggtgataaaccaacttcccacaatattgcgtacagttccccaatcaaccgcatgtgcaccgacagtaatacaagcaaaaccgacaattgcaccgataattgcatgagttgtagaaaccggccaacccatttttgaggcaattaataaccaaatccccgatgaaaaaagagctgccatcataccgaaaaccaaaatttccggagtatcagtaaactgcattggatctataacgccgcttttaatcgtttctgttacttctcctcctgcgaggtaagctcccgcacattcaaaaaacatcgcaataaaaattgcttgttttgctgtaatagtacctgaacctactgatgtccccatggcatttgctacatcattagcacccacaccaaatgccatcaaaaaaccgaaaacggcggtaataataacgagtatagttccgtattcttgtaaaatttccatagttgatcactcctatgcatttatcgttatgaacgagctaacattaattcaattcgtgaacccacacgttgtgcttgatcagctaaaaccccaatccatgctaaagtttcatataaaaacatcacatcaataggactgtactgattttctatgtttcggagcatcatacgaagtttgatttgcatatgatctgtatcatcttcaatggcatccaactcatggattaggttattgacgagagtcagttcatgtcctttaaatccggtttccaataacgcatccatttcttcgatcacacgatttgcttgaactgtcgcatctaaactacgataaacatatttcataaaatcctcttgcatttcttgaggaaaggtaaattggcgaccgagcattctcccggctatatctttggcacaattcgctaatttatcttgttgagttgtcaactctaataaatctgtacgatcaattggcataaaaagacctaaagggagcttcaagcgaatttcacgtttcagtgtatcggcttgacgttcaagttctgagagctcagcacggatctttgtggcattatgccaatctccggcaaaggtactttcaaagaaaggaatgagtagtttacaacattcagttactttatcagaatgacgctgtaatggcgttagaggtgaatgggcaaataatcctagaatattattcattgccatatgaattaaactccttagtggatttgataaaaaattcaggcgcatattaccttatgcgaacagaaaaatatagaaatttcatcgaaaaaaataggtttttagtagataatacaggcacgcatttcttagtaaggaaaggaaaatgaccaaggaaatagagcttaaattgagtgtatcaaatgcctttgctcaatttttaagtcaagaaatggcaagttttcatgtgttaaaacaagagaaggtttttttaggcaatacctattatgatacagcggacagttattttgctcggcacaaaatgggcttgcgtgttcgtcaatataatagtgattttactttaaccttgaaaacaaacggtgatgtgctgggtgggttacattctcgccctgaatacaatgtatctcaagaaagtgcggtgccaaatttggcgaaattaacagaaatatatgacttaccgaattggcatgaatttgtcttacagcctattttccgcactgattttgagcgttgtttatggttggtagaatgcgggtatgatgtggaaattgaagtggctttagatcaaggctggattattgcaggagaaaaatccgttcctatttgtgaagtggaatttgaattaaagcagggaaaaacagaggatttgttaaattttgtggcaaatttatctttagaaagtgatgttcgcttaagttcagccagcaaggcacagcgaggttaccaattggcatttaatatacaacctcaaattcaggattggatcgcaaaatggcgtgagtttattgtcttagcaacacatgaaaagatcgcttatttagtaaaatttgaacagcaattaatcgaagaaagtgtgatgctgggaaaagattattttgcacaagaatttttgcgtacagtggagcgaatcggtgcattttttaatctatatcacttttatagtgagaacgtaacgttattggaaaatcaagtaaatcttcaattgacgcaaggcattactcatttggatcagaatttgcttgctgatcttgttgaacgtaatgcttatttattgttgcaaattaaagacattattcggcgtcatagtgaaaataaaaataatgcacttgcgattgaaaaattatttgcattatttcatagcggtcagtatgtcaaacgtatgttagatttaacgtttttaacactctaaggatacagcatggcaaaatcacccaaaacagcctacgtgtgtaatgactgcggtgcggagtttgcccgttggcaaggacagtgttctgcatgtaaagcatggaatacgattagcgaagtgcggttagtttctacagcaaaagtgaaaaatgatcgttttagcggatatgcaggagaaacgaaagccaaaattcaaactttagctgaaatcagtttgcaagaaacgcctcgttttaccagtggttttagagaattagatcgtgtattggggggcggaattgtgccgggtagtgcgattttaatcggtgggcatcccggtgcaggaaaaagtaccctactgttacaagtgatgtgtggacttgctcaaagtatgaccgcactttatatcacgggcgaagaaagccttcaacaagttgctatgcgagctaatcgtttaggattgccaacggatcgtttgcaactcctatctgaaacctcaattgaacaaatttgtcatcttgctgatcaactaaagccgcaaattatcgttattgactctattcaggtaatgcatttatctgatattcaatcttcccccggaagtgtagctcaagtgcgtgaatgtgcggcatttttgacccgttatgctaagacaaggcaagttgccattatcatggtcggtcatgtaacgaaagatggaacgttggcaggaccaaaggtattagaacatgcaattgatgcatctttattgttagaaggcgaatccgattcacgctatcgcactttgcgtagtcataagaatcgttttggtgctgtgaatgaattgggtgtttttgcgatgacagagcaaggtttgagggaggttaaaaatccttctgcgatttttttaagtcgtggtgatgaacaaacgtcaggaagttccgtgatggtagtatgggaaggaactcgtcctttattagttgaaattcaagcacttgttgatcattccatgttagccaatccaagacgtgttgcagtaggtttagagcataatcgattagcattgcttttagcggtattacatcgtcatggcggtttacaaatgtccgatcaagatatttttgttaatgttgttggcggggtaaaagtaacggaaaccagtgccgatcttgccttattgctggcattaatttccagctttcgtaatcgacctttgccacaagatttagtcgtgttcggcgaggtaggtttagcgggggaaattcgccctgtaccaagtggacaggaacgtattagtgaagcagcaaagcacggttttaagcgagctattgttccctttgcaaataaaccgaaaagtgcggtcgaaaatatgcaagtttttacagtcaagaaattagcggatgcgttggcgatattagataatttttaacaaaattgccggataaaaacgaataaatatctaaaaaatagtgtaaaattagacaaaaataaatattttatgcggaatttctatataaaaagggatgaataatggaaaagaagattaaatcacttgatagtattgatataaaaattcttaatgaattacaacgcaacggaaaaatttctaatattgatttatccaaaaaagtgggattatcgccgacgccttgtttggagcgggtaaaacgtttagaacgccaaggcattattatggggtatcgtgctttattaaaccctgaattattggattcgcctttgttggttattgtggaaattacattagttcgtggtcgtcccgacgtgtttgaggaatttaatgtggcagtgcaacaattagatgaaattcaggaatgtcacttggtttccggagattttgattatttgttgaaaactcgtgtagcggatatggcagcgtatcgcaaattgctcggcacaactttattacgtttaccgggggtaaatgacacacggacttatgtagtgatggaagaagttaaacaaactaattttttacaattgaaataagatgattaaacgtattaaacaattttttttaccgaaaagggatttagtcgagtttttattaattctcaccgcactttggggcttttatttgatcgttgcttggtttagctatagcccgtttgataattcgtgggcgatatcttcttttcaaacggaaactattaataaagcaggtgcattgggtgcttggatgattgatctgtttttcacgttttttggcgtggtaggtaatatcataccttttgtactatttatcgcacctatttattttttacatactaagcgaactcaagggttaacttggggaagattttttcttcggatattgggttttgtgacattgctggttggtttaatgatcttggctactttaatgttggcaaaaactgaacatcatttatcgggcggtgtattaggtgctattttaatcgttaagttatatccgctattttctaaccaatttcccttaattattattggtagcattgcttctataatcggttttattttctgttcgggggcatctttattttatttaatgatgaattgttacgactggctgacaatgaaagataaagaatctctattggatacacaatcgaatggtgctgattcagttgaacaggaattggaagaaattatcatacaatcgccacctatagaacaaaatatcgccaatgaagatactgaaaaacaagaacttgaattagtgaatattagtagttttattaatattcaagggttacctgatgaacaagtggaagaacagcaaaatttagcagatccgatgttgatgaagcaaaatgaagtggttgatattgctcaaacactaggcgatttaaagcaacaagaattgcctattccaagcgtttcattgtcaacagaaaaaaatgaagcgttagctttgaaaacagaaaatattgcagaaccgaccgcactttctgtcgttgaggaagctgacaatcacaatataaatgaacttgccaaacaatttgctgaatttgagcaacaacgtttattgaaaatggaacaacaggcaaaagaaatcggagcagaggatgcgttaaaagtgattttagctgaagaagttactgaagacgtgccggcggttatggaagaagttattgaagaaaaagaactcagtcaaagtgcggttaattataagacttatggcgatagtttgattcaccccgcattacagcagaaagtgactgttcaggaaaaaccgacaacaccattgccaagtttagatttacttgaacgccgaacgatccaaacttataacattacccaagaggaaattttagaaacatctcaacgtattatgcaacagttacgtaattttaatgtaaaagcggaagtgcgtgatgtactcgttggtcctgtggtaacacgttatgaattagaattacagccgggagtaaaagcctcaaaagtgacaagtattgatactgatttggcaagggctttaatgtttcgttcaattcgtattgccgaagtgattcctggaaaaccttatattggaattgaaacaccgaatatacagcgtcaaattgtacctttgcgtgatgtattggatacggatgagtttcggcaatcaaattatttattaccaatggcgttaggcaaggatattagcggtaagcctgtgattgtagatttagcgaaaatgccacatttattagttgcaggatctaccggttcgggtaagtctgtcggtgtgaataccatgattttaagtttacttttccgtgttaaaccggaagatgttaaatttattatgattgatcctaaagtagtggaattatctgtctataacggcattcctcatttacttacggaggttgttacggatatgaaaaaagccgctaatgccttgcgttggtgtgttgacgaaatggaacgtcgctaccaattgttatcagccttaagagtgcgtaatattgaaggatataacgaaaaaattacagaatatgaagcgttaaatatgccaattccaaatccactttggagaccgggcgatactatggacactttaccgcctccattggaaaaattaagttatatcgtacttattgttgatgaatttgcagatttaatgatggttacaggcaagcaaattgaagaacttattgctcggttagcacaaaaagcacgagctatcggtattcatctgattttagctacacaacgtccatcagtagatgtaattacaggcttaattaaagccaatattccaagtcgtattgcctttacggtagcaagtaaaattgactcaagaacaattttggatcaaggcggtgcggagacattattagggcgtggcgatatgctttattctgcacaaggatcatctgagttgttacgtgtacatggtgcttttatgagcgatgatgaagttgtacgtgttgctgatgattggcgtgctagaggcaaaccgaattatattgaaggtattttggacagcgtaaatgacgaaagtaacgataatgaaactgactatgacagcaatggtgatctggatgacttatttgatgaagttgtggaatttgtcataaacactggcatcacatcggcatcttcagttcaacgtcgtttccgtgttggatttaatcgagctgctcgtatcatggatcaactggaagaacaaggtatcgtttctccgctacaaaatggtaagcgggaagtattagcgaggaaaggggattactaaattaacattgcgatataatttgtgaaaaaaaccaccgcacttaattagtgcggtggttttttctttgggtgtagcaagttggctaaattaccattgataccccacaccaaccgaaccgccgacatcgcccgttgaactgcgagtaccttgcaatcgtagcgttattttaccattatcactcactcgtgaataacctaacgccagtgcattttgtcctttaaatgttccggcagatgccgcaaacatggatttacccggcacagaagacatcggcaacccagccgctgccaacgctcctgcaattcctgcacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcacgggtttcaaaagaggtcatgtttttcaattggtcggacagtttgacttctaagcctttaccgtcttgagacatttccactttgatattaccggcagcggtgcggtcgctgttaaatttattgnnnnnnnnnnnnnnnnnnnnnnnnnnnnnnnnnnnnnnnnnnnnnnnnnnnnnnnnnnnnnnnncatcattgcccttgaacttcatgcccgatttcgctaccgcttgcaaatcaccgattgttgctgcgttggttaaatctattttgctatcttgtttcactaactctgcaactttttcatagcctccgtaatttttctcatactctttattggtttctgttaagcctttttgagcttcttttaaatcatttcttgcttgttcaagtgcttttttcgcttcatcaagttttgtttgattttctttgagcttggcttctgcttgtgttttatcattgccctctggcaacgcatttattgcttgttctaagctacttaccgctaatgctaaatccgtgaaagtttgtgctttgtccgaaagtgctttagctttctcgctcaccacttttactttttcctcaacggttttggtgagttcagccgatttttcttgagtctttttcttctcttcttcggtttgtgcttctagcccaagaccactcgccacattgctaatcccaataggtgcggtgcttggttcggctttgatcacgacttgtttcttctcttcctcagaaatatcttgaagtgtgacgtcttttaattttttgaaactaccatctgcccctttcacgactttttcattgcctagataaaaatcaaatggacggttattgttcagatttttaacctgttcatcgacatagtttttattcgttgcactagtgccatcagctccattttctaaatcttttagaccggtgatttttcctgagcggatttttttaccgtcagtctcttttgtcgagaacgtaatagacggttcttgacctttctcaaacgattctagactgtctttatttaccggttttgcccctgctttaatagtgattgatggtgaatcagcaaatggatttgctccatttgctccgcctgtgttattcgccccttgtggggtaagtgcaataccgtctttgtcaatttgtactttcgctcccgttgtgccaacttggaatgtggcattttctgaagttaaagaaagtttggtgacttcttcatttgaaccagtaccatttccgcccgcacttcctttaggtgaagaaattgattttatattttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtgttgcactatcatttccatcttttacagttacttggatattctgtccgttcgtaaacttcaacgtatcgccacgaccgatttcgataggcttaccactaccattttcaaccttgaacttaaatttatttaacgcttgttcaaggtagcctttggtaatgaggtcattttcaccaactgtacttccgcttgcaccacttccgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntattgagtgattaaattatcacctttaaactcagcaatatttggttgtgatgaagtccccgccggagctggtgtagcagacgaaccagcctgattcatacctaaacgcacaatgctaagggtcgaaccaagatagtgcggtgtgttttgagtgccatttgttaccgcactttgatccgctctgaacatcaagcccttgttaatagccgtaatgctttcattaatagcttctctaaaggttgttggggcttttatttgtccttgctgtgttccttgctgtgttccttgcgaggctctcttatactcaacttttgcaaaagttgattttttgaaaccatcttcactatcatgtttctctgctccaagtacatcaaaacctaatttaccaaaaacgctaatcacttccgcaagctgtccgccgttgatggcatcggttgagcctgtttcgactttacctgcggcaacgttggtgataatccgctcgctacccttatcccctacactgactacggttttgtcttttgtcataccagaagacgttcctgcacctgtccaagtgatttttaagctatttttaccagcaaaaacctctgcaccactcggtgcattctgcttctctttcgccttagaatttttacccaacgcaatggaatcgcctgcattttcttcaactgtcgcaccctcaccaacggcgaccgcacctgcggcgttttgcttaacattcgcaccgtgaccaactaccaccgcactttgtgctttggactctgcttctctaccaatcaccacggaattatctgcactttctgctttggcaccgttaccgaatacgagtacgctatcattattacttcccgttacctcaatattcgaccccaacgccacaatgtcattaccgttcgtaattttggtgttattaccgatagacactgcccattcggcattggtgattttcgtatccctacccacaccgatggattgtttggcattttgtaaagttactgtatttcctatagcgatgacagaatcgttactcttaccattattttttgaaatggtaatattcgaccccaaggcaacaatatcatttccgcctgaaacgttgtttttattaccgatggaaattgcccattcggcgttttgtaaattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnataatgcaattgtgaagcggttaattgtttgactgtaacagcattgtcctcatcctttccatctgccaagccagtaattttgactttgttaccatctgctttagtaaaggttaattcacttccaccgacttttaataccgctgagtttccaccacttgtaccgcttgcactatttgcaaaggttaaaacattattctcatctttcccgatagaggtaatgtcttttaaattcgtgttcaaagcgatttcaagtattccaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggaattatcgccgttggtagacccattgccgacattgattatcgctaatttattggttactttatccgtcaaagaaaatgtaatttctttaccgctaccatttgaagaagccttgctggttaaatacgttccatcacccttaatcgtgattttatcgccgagtgaggctttaacgtcaccgccagtattccctgcaaaggtcaagcctttagtcacaatcgctttagcgacttcggacaggtctttcacattgacggcgttgttggcaattgcaccgctattgccaccgctagtcgcaccatcagggtttcctgagaggactttttcaataatgccagcatttccgtttccagtacttccaccagcaccatttaaccctaaaccactcgctaagttagtgagttttttgctatttaaatctaaaccgctgtcactaaaggtatagcttgctttattggtacccactttaatggtggcacctgcattgtctacgacaatgcttgaaccgtctttcgtgctttctaaggtagctttaccgtcctcaagttttaatgctgctttgtcgtttcctttactaatttcagacacgccactgaatttaccatcggctagggtaacctctgaactacctgccttgaaagtaattttgttatcacttccattacttccacccaaagcaattttcgccttctcgccattggcaatagacgcaataccttttaagtttttagacaatttaatttctagggtatctgctttgccatttgtaccgtttttcttcgccacgataatattatcaggtgcggttgtaatttgagttgttgcagttgttcctgatgctgaagttgctgtttctccaactattttcaacgtctcgcccagttttctagtaacatcttgactgtcatttccttggaacttcaagcctttttccacaagggctttcgccacttcggataagtcttttacattgatggcattgttggaaattttgttgccgttgttattacctttatcaggatcgccagcaagaacattggcaataactgtactattatttccggcatttccaccagtaccgctagcatctgtcaatcctaaaccgctcgcaagtgcggtgatttttttattaccaacatggaatccttttggatcaaaggtgtagctcgcaccatttgaaagaatgacaacattggtattcgcattattgcctttactattttcattaaacttaatttcagtttttacttttgtgccaccattaccgccattggcgacctccttaccggcaatcgaagcaatctcttttaatgcctcattgacattaaacttaacaacaccgttactttccactacagcggttgtgtttgtaccatctttaaaattcaaaccatcgcttaatttgacggtataatcacccgaaccattcgccttgtatttaatgacttggtcggtaatttttccctctatactggtttttactgctgtaatagctttctcgtttttatccgctttagtagccgtatcatcaatttttttcgtgattttctcatctagcccaattttgatcgtatcttcaccctcaacagaggttttaatttgatcagtagtgcctttcactttcaatgtacccgtttttaatgaaatggttttttcagcgttactgtctgtgtcaaatttcaagtctgagctgaaatttttaaatttatcatcaacatattttttagtggttaaagtcatttcaggacttttatcagtaacattttcagttactgttactttttcaaaacgtggatcttttttaattccaattcggaatactccttgcttcttaccgtaattagtctttatgttgtcactgacaaaatcaccattatcaataacaccggattgtattgttattttttctcccaaatatcttgtaccttcagttgttccatcactaaaaataaaaccactattaatttttgtgatgttagcgtcaatagcctctttaaatgttttttctgtagctggtgttgaagcagtggctccgttagaacctattaattggttaaatgttgatttcgtaaatccacctgaatttactgtcgcacccaatacatttgttgctaaattctttaattgtccaaaattggctgcatcggtgtcgtctgttccgtttgctaaaccggtgatttttttgytgcctaantctaagccatctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctcctttaatatccagtttgttagttgctttaaagcttccagtattgccagttacggtaaaactcgtgacaactttgctgaatttgtcatcgacgtattttttgttgacggcgtgattcttatctgtagggttaccggtaatttttacagtattaaattcaggatcgtcttttaagccgatggtgaatgtcggttttgaattatcatttttaaattgcgtttttaagtttttacctagatgtgtttttgaattacctgattgaatatccccagcnnnnnnnnnnnnnnnnnnnnnnnnnnnnnnnnnnnnnnnnnnnnnatttgttccatcactaaacttatatcctttgttaatagcattaatcgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcagctgattccccgtaatcgcttgatcggagtttagttcaattttgccgtcttttaaattgccgaattggattttgttaccaagatcttttgttcctattttttcatcgaagccttttgctccgactaatacgttggcttcaggaattgccggagaatttgctaacggttcgccggtttgggtgttgactttgtagaatttaccgtcaccagctgattttaccagcttcactttcttgccgccttcttcggtgtagtaaacaacaagtccttcttttttaacataatataatgctcttagttgtcctacagtggcggcatcactatccaacgcgcccggtgcgacattcactattctacgcaatccaacatgatttttatttcctttagatgaaccgggaccgccctttgcatcttttgtcgtatcccaacccccaacggaaataacccctgccgatgtatccgtttcaattctataactggaaccttccggtacatatccctctaaactagaggcattgtaggcatttgttccagttaaactggctgttgttttatctgtatcagtataaaagtaattcgttgttgatctatatcctaaagcgactgaattttcggatgatgagcttgaattattccccaatgcgactgagtttttagcattttcattaatcttagaatcatttcccagtgccatagatgattctgaaaaagcagatgaaccatatcctatggcaattgaattatctttcttaaccccaactccggagcctatcccaattgaaccagttcctaatattgttgtaccggttccgatagcaaccgagttttctttatgtacgtttgttccaatacctatggctattgtattggttgcatattgtccaacattatttaatgcccctaagacgaccgaattagcacccctgacataagaggcactacctatggctatggtattatctccattatttgaaatgtgataacccaaggatattgcatgatctccttgttttttcgttttctttatatcttctgtagtggtgatttctatctgagattctttttcatagtcaaatttatttgcctgttcaattttagttattaagtcgcttattttattctgtccattaaaatgattggcaggaaatccatacttaacaatttcattgttatctcccactttaagatcattaatatcagtagttacagttttaaaatgaggatcttgattttcattgacagtaccaagcttggtttcttgcataatttgagttctgaatttctcagctgacatatccgttaattctgcattcgacgatacattaggacctatcgctattgaaccccttcccgctgcttttgctccggaaccaaaggataatgatccttctgtggttgattcagccgcatttcctatggcataagaatttttcgcaaaaacccttgatgagtcacctattgctgttgctccgtcagcacctaaaccgacaaacgcacgaacaccgaccgccgttgatctatcggctaatgcaaatgataatgtccccatagccagtgaagcatttccatatccaactgatcttgaccctattgcgattgcccccactccggctgcataggttggggaatacattctatggtcttttccgtcatctgttctaacatattttttggaaaaatcagaccaatctaatatatcgctatacgtaactttattagatgctctacttccactatatccataaatttgtttgattgtcgtttcaggtaatctatctgcaaatccgccttcaccggctttaagatttggttctccatagttaactttgttcccattttcaaatatatcatctcctcctattgcgacagatgccccaccagctgccataacgtccgcacctaaggctgtcccttgtgctactgcataaacattattccctattgctgttgcttgtgcaccttgagccttactttcagctcctaatgcagttccattggttcctgctactatagattcgtatcctacggctgttgctccatctcgaagtgcttgagctccgtatcctacagcaacctgtccttctcctgttgctttagttttatctcctgctcctattactacaactttttccaacttggtgacttgtccatttactttatgtaggtcttttttccctaacacaatattaccattattattattttctccatattcattgccccaacctgctatacctacagttcctttactttcattaatagctaaccaagcagcatttgatatagtactcaccccaaaaaatcccgcaattaccaacaccaacggtaaaaccttaaacattcgtaaaaccccaccgcactttggtttctccgaactgctcgccacttggcgattgcttgccaactcggaaacggctttacattgacctgttgtaatatcgtatttggttttaaatattttgttcatagaattactcgctttaaaaattatctgttaattacttattaagtggttattgatcgaatctgttattgattgtttatttattatctcttactgattatttattaaactttagagagaggggataaccctaaataggcaacaccttgctttttaaggcaaagcagaaaaaggcgaatgatattttcgccgagggttttaaaaggggaaatttgggtatgacgagaagttaaaaattttttaaaatttattttgcaaggtttataaaaaggcgttagcctaggctgtaggctgtaggctgtaggctgtaggctgtaggctgtaggctgtaggctgtaggctgtaggctgtaggctgtaggctgtaggctgtaggctgtaggctgtaggctgtaggctgtaggctgtaggctcatattgttttcgtctatcaaatggttaagtaataaatttgggcgattttatcccaaatttattagtaagggaatgatttcgtgtattttatttgtattttacacttgttgttgattgtttacgatttgcaaccatgatttccacaacaaccgtgatgttcatggtgttcatgatgatgtccgccacatccgcaatgatgaccctcttcatcattatcatgtgcacaacaaccgccctctgtatgaatatgaccatgtgccatttcttccagtgttgcttcacgcgttgcaatgacctctacggaaaaatgcaattcttgaccggcaagcatatggttaccatcaactaccacctcattttcatttacttcagtgataacaacaggtaatggcccaagatccgtatctgcgataaaacgcataccgactaccagctcatcaacgcccacaaaaatatctttgggtacacgttgcaccatgttttcattatattctccgtacccttcttccggttttacacgcacttcgaatttatcaccgacagatttaccttccagtgcattctccagtccgatcacgaggttctgatgtccatgtaaatattctaaaggttgatttgccggtgcttcatcaaccaatacgccgtcttcagtgcgtacttggtaagcgatacttaccacaacatttttttctactttcatttttattcctttatgctgtaaaagtgcggtcattttagccaaaatattggctattgtcattcatcttcatttggatattcgtcaaaaaattctccgtcattaccatattcatcttctgttgcattcggatcttcgaagtaagtaccccatccgtcataaatgccgccgaattttgtgattaatggcaataagtctttttgttgtgcatcaatgatttctgcttttaaattaacttcactaatgatgtcaaagcagaaaatagatttaccttgttcatcttcaaattcttccgcttcagaaacttcatagcctgctttgaaagcatcaacggcgattttttctaacttatcaaaatcgtcatgtgcgatatgatgttcaataatatataaagcatcaggatcactaccgtcattgagtaaatcagtaataatttttctggtttcttcttggagatctacaagtgcagtcatattttttcctttatgtttatttagggagtggggataaattcattgcgttgatataatttaattgtcgccatgcttcatagacagtaaccgcaacagcattggataaattcatgctacggctattttctatcattggaatacgaattttttgtgttgtcggtaagttatctaaaattgacattgggatacctctagtttccgggccgaacataagatagtcgcccaactcaaaatttacttggctatgtgcaggtgtaccttttgttgtgagtgcaaaaagacggttaggttgttctgtgtttagaaattcattaaaagttttatgctttttgatttgtgcaaattcatgataatccaaacctgaacggcgtaattttttatcgtcccaagtaaatcctaagggttcgattaaatgtaaacgaaaacccgtattggcacataggcgaataatatttcccgtattttggggaatttccggttcatacagtacgatgtctaacataacaaaatcctcgtttatgcaacatggggaattttactcttttatcaactaatcacaaaattattcctaccgattccttcaaaaaatacttctaagcaaacagaaagtgcggtctaaatgtgcataaaaaaggcggagaactctccgcctttcatgatggaaaatatattattaagctttaggaccagctgcgatgagtgcttttccttcttcatttgtagcatatttttcaaagtttttcacgaaacgacttgcaaggtcttccgcttttgcttgccattgtgctttatccgcataagtatcacgaggatctaagattgcaggatcaacacccggtaatgcttttggaatggctaaatcgaagattggtaatgatcccatttccgcactttcaattgaaccgtctaagatagcgtcgataataccacgagtatctttaattgagatgcgtttacctgtaccgttccaacctgtattgactaagtacgcttcagcaccagaatctttcatacgttttaccaacacttctgcgtattgggttgggtgcaaacttaagaatgccgcaccgaaacaggcggagaatgttggcgtcggctcagtaatgccacgctctgtaccggctaattttgcagtgaaaccggataagaagtagtatttagtttgttcaggtgtgagttttgaaaccggaggtaagacaccgaacgcatctgccgttaagaagataacttttgttgcatgtcctgcttttgataccggtttaacaatattgtcaatgtggtaaattggataagatacacgagtattctccgtttttgaaccgtcatcaaagtcaacggaaccatcctcacgaacgacaacattttctaacaacgcatcacgtctgattgcacgataaatatcaggctcgctttctgcggaaagtttgattgtttttgcataacaaccaccttcatagttgaagacaccgtcatcatcccagccatgttcatcatcaccgattaattgacgtttcggatcggttgaaagcgttgttttacctgtaccggataggccgaagaaaatcgccacatcgccatctttgcctacgtttgcagaacagtgcattgaggcgataccttttaatggtaagaagtagttcatcattgagaacatcccttttttcatttcaccgccgtaccaagtaccgccgattaattgaacgccctcagtaatgttaaatgccacaaagttctctgaatttaatccttgctctttccaattcgggttagttactttagaaccgttcataaccgtaaagtccggtttgaaattttgcaattcttcatcagacggacgaataaacatattttttacaaaatgtgcctgccatgcgacttcagtaacaatacgcactgctaaacgtgtatcagggtttgctccgcaaaaagcgtcgataacaaacaaacgcttgccggaaagctgtttggtgaccaaccctttcaaactttgccaagtttcttggttcatcggcttattgtcgtttttcgccgcatcgctcgtccaccatactgtattttttgttttttcatctaaaacaatgtacttatcttttggcgaacgaccggtaaaaattcccgtatctaccgcaaccgcacctgaagtggtaacaacacctttctcgaagcccgctaaacccggtttggtttcttcttcaaaaagttgttcataactcggattatggacaatctcttttacatcatagatgcctaattcacctaattcatttattactttgtttaagtcagtcataaaacacctcatagttaaaagttaattttaaaagttaatcatttagtggtagatattatagtgaaaataagaaataaaaaatgttatcttgatctcaaaattgaaaaataaatgaaatgaatgttgagaattataaaaagcgatggttgaaccatcgctttgaattaagattaatatgattatggataaacaggaagacgtttgcaaattgctaatactttttctttagtatcagcaatgacttgttcatggttatctttattcatactgtctaaaatatcgcacatccaaccggcaagttccgccacatcttcttcgttgaagcctcgacgagttacagcaggtgttcccacacgaatacctgaggtaacgaacggtttttgcggatcattaggaaccgcatttttattaacagtaatattggcacgacttaacgccgcatcagccgctttaccggttaagccatgattgactaaatcaactaagaataaatggttttctgtaccgttagagacaacgttgtaaccacgttgtttaaaaacttttaccatagcttttgcattttttactacttgtgcttgataagttttgaactcaggttccaaagcttctttaaaacaaacggctttcgctgcaataacatgaactaacggtccgccttgtcctgccggaaataccgcactatttaattttttgtaaagttcttcattgccgttggcaagaattaaccctccacgaggccccgctaaggttttgtgtgttgtggtggtaactacatgagcatgtggcattgggcttggatatacaccggcggcaataagccctgcaacatgtgccatatcaacaaataaatatgcacctacttcatcggcaatttcacgcatttttgcccagtcaacgatttgagaataggcagaaaatccgccgacgatcatttttggtttcacttcatgagcctgtttacgcaacgcatcatagtcaatcagtccttcggatgtaataccgtattgctccgctttataaattttaccggagaaactgaccgaggcaccgtgagttaaatgtcccccatgagcaaggctcattcctaaaatggtgtcccccggatttaataatgccatataaaccgccgcatttgcttgtgagccggagtgcggttgaacgttagcataatctgcaccgaacaactcttttgcccgatcaatcgctaattgttcaacaatatctgcatattcacaaccgccataataacgtttacccggatagccttctgcatatttattggtgaattgacaaccttgtgcttccattactcgtgggctggcatagttttctgaggcaattagctcaatatgctcttcttgacgaagattttcatcttgaatggcttgccataaaaccggatcgtaatcggcaatattcatacttctttttaacattatgttttcctctttgctcacttatgaaatggtaacagtttacctgttttaacttaaaaatttaattaaaaattaattcctatttttcatcggtgtaatgaaaaaatttcattcataaataccgataagattgaccgcacttttattgattttctcttgctacggcacgataaccaatatcttgccgataaaaacgtccgctccattggatttgtttcgccaattttaatgcttgctgttgtgcggcaaaaacattttcacccatcgctgttacacaaagcacacgccctccattcgtcaataatcgctctcctttttgctcaactccggctaaaaaaactttttgattttcacccgcacttattggcaagccttgaatttcatcgcctttgcgatagttattcggatagccttctgcggctaaaacaataccaagtgccgcttgctcagaccattcagatttcacttgatccaatttaccctcgcaggcatttaaacaaagctcaaccaaatcagaccgcatacgcatcataatcggttgggtttcagggtcgccaaaacgacagttaaattcaattactttaggctgtccgtgtttatcaatcattaaaccggcatataaaaaacctgtataaatattgccttctttcgccatgccattcacggtaggataaatgatctgttgcataattcgcgtatgaatttccggtgtcactacaggtgccggagaatacgctcccattccccctgtattcggaccagtatcattttcgccaacacgtttatgatcttgtgaagtcgccatcggctctacatttttaccgtctaccataacaataaaactggcttcttcaccctctaaaaattcctcaatcactactttgctaccagctttgccaaaagcattaccggaaagcatatcttgaatagctttttccgcctcagccaacgtcattgcaacaatcacacctttgcctgtagccaaaccgtctgctttaacaacaatcggtgcatctttttcacgcacataagcaatcgctttttctgcatcagtaaaactgcggtattcagcagtaggaatatgatggcgagcaagaaaatctttcgtaaatgcctttgagccttctaattgagccgccgcttgagttggaccaaagatttttaaccctgatgctcgaaaagcatcgaccacaccaagcactaaaggtgcttcaggtcccacgatagtcaagccaatttgattttcttgtgcaaagttgaccagtgcatcaatatcagtagcggaaatagctacattttccaccgcacattttccgtctgtttccatagctgtccccgcattgccgggtgcaacaaatattttgcttgctaaaggtgattgtgcgactttccacaccaaagcatgttcacgtccaccatttccgataattaaaatattcattgtttttccttccttaactgttttttaggaataaagaaagcgggaggcgtattttccttaatatttaaataccctgaatctcccgttagaattgaatgattaattgtaccatccctacaatcagatatatccatatcataactcatgatgttaattaaaaatgtagccagttgctgatgaaacatttttttacaagatgaaaaatggttatgaaaaatatcttgtaaaaacttattttcagaataaataaaaataggcactaaataattagcttcatttaatgttccttgattatatacttcattagaaacaaactgtccgtgatcggaagtataaattaaaacccaatcttcaggttttaaagatgttttaagataattaaacactttttcaattaatttatccgtattatatatagtactatcatatttatctaaaggggtgttctctttgaaaactttttcttgctcagataaataataagcatagggtgtatgagatcctctttggtgtaaaacaacgaagtgcttcttacccccccccacctcacttaaatctatattttccagtaatggaaataagttatgatcatgcattccttcagaagatttatacccaaggctattaggaaaacgcaaatcatcgacccacgttttacccataagactcataatcatcatttgattttcaggttgtgaagaatagaaatatgtttcatatccctgctctttagctaagcggaataagttagttcttccgctaacaatttgttctaacccatttggttttggaatggcattaaacaatgatgggagagaaatagcagtccttgagcctgctgaatatgcaggttttaataatgtttcagtaggaaaattttttgataaagatgttaagaatggggtggtttctctctcataccccaatgcacttacattatttgcacttacactttctcccataatccaaataatattaggtatttggaatgagaatttaggtttcggcttcggcttatctttgtaataaaccgatacgttgctcaaattaaataaatcatagggtaaagttctacctataaaatatccaaaagaaaaataatttgctttaattcttgagtagcccggattggaagtaattcccagttcttgatcagaataaaaactacgaataaaaatataagccatacttaataggaataaaatatctgcaattaaatatgttttttttctaaatcttgaaatagaagaaaaaataagaatatcaaaaacaccccaaattatccctccggatattttatccaacatatgaataccggcatttgtaacttcccaatattctttaaacattaataaataatttgtaccattaatccagctttgatagacctcataatgaacattattaactaacgtactacaagaaaaaaataacaaaataataaaacgagttatcttatattttgagaaataaaataatgaaattaaaataaatattattagaaaactctcactaattttgtataaactatttattccaaaaaaatagcgataaagtatttcactaattaataaaacagcagaataactcaacaaaacaatgatatttttcatgaaaatccttatttattaatgtctaaaatgacgcattttagtgagtaccattaccatattatgctcattggcggcatcgataacttcttgatcacgcattgaaccgcccggatggattacgcattcaataccaacttttgcggctgcatcaatgccatcacggaacggaaagaaagcatccgatgccattacacagccttttacttccaaaccttcatcttttgctttgatccctgcaattttcgctgaataaacacggctcatttgtccggcaccaatccctacagtttgattatttttagcgtatacaatagcgttggatttcacaaattttgccactttccaacagaataaaagatcttccaactcttgtttggtcggttgacgtttactgactacttcaagatctgctaaatccaccatagataaatcagcctcttgtaccaacaaaccgccattgacacgtttaaaatccaagcgttgtattgcactttcccaattgccacacatcaataagcgaacatttttcttacttttcacaatttcttgggcggcggaactgacggtcggtgcaatgatcacttcaacgaattgccgctcaataatggcttttgccgtgtcttcatctaactcacgattaaatgcaataattccaccgaaagctgaggttggatccgtttggtaagctcgattataggcttcgagaatatccttgcccagtgctacaccgcaagggttagcatgcttaacaataacacaagccggctcggaaaaagatttcacacattcaagtgcggcatcagtgtcggcaatattattataagaaagtgctttaccttgtaactgtttagcggttgagacacttgcttcttttacgtcttgttctacatagaatgctgctttttgatgaccgttttcaccataacgcatagattgtttacgtataaaattaagatttaaagttcgtggaaattgaccgcacttcgcttcagcttcttcttcagctctgaaataaggttttaccatttgtccgaaataattggcgatcatgctgtcatattgtgcggtatgttcaaacgctttaatggctaaatcaaatcttgtctctaatgttaaactatttcgattttgatccatttcagcaagaattgcattaaaatcgccattattgactacaatagccacatgttgatgattttttgcggcagaacgtaccattgtcggaccgccaatatcaatgttttctactgcatcttcaagtgtgcaatcaggttttgctacagttgccgcaaaaggatataagttcactacaaccatatcaatagcatcaatttgatgttgcatcataacttcatcatctataccacggcgacctaaaatgcccccatgaattttaggatgcaaggtttttacacgtccctccatcatttcaggaaaacctgtataatcagatacttccgtaacaggaaccccgttttcagcgagtaattttgccgtcccccctgttgataatagttttacacctcgtttaactaaaccttgtgcaaattcaacaattcctgatttatctgaaacgctgagtaatgcttgacgaataggatgatttaattgcattgaatatttcctttattttaaccgacaaaaaacgcaggcattataacgcaaacgtttgctcttgtgtaaataaaaaagcctataattaagtacagaatgaatacatgtagcggtaaaattatttttccactgctttatatacgcactaaaataccctgacattttttgcaaaaatataccgcacttttttgttgaatgttgtgatgacgacgtgcggacaattgatgggtttgacattgacattgataagtaaacgttttgcctcttacattcgttacatcaaactgatgacacgtatccgccggaagctgaaaaatcttgttcatcacatgttgccattctgagccgtgaggttttacacgcccgaattgttgatacacaattaaatgtgccaactcatgaggaactacttgctgaataaattgttgcggattttccagcaataaagtgcggtttaattttatgctgttttgttgtaaataggcgacccctgctttcattcctcgcacatcataactgactgtcggcatcgcaaaattacattgaaaatattgttcagccagtattaagcaatctcttaaacgtctttggatttgcatttttatatgacgaaactcagctaaattttgttcagttttaggcataaagtgcggtcaattttgggtaagatttataaacaaaaggcgaactgttgagttcgcctcatatgagaaattaatcgttattttaaacttgcggcagcacgtaattcttctgcacgatccactttttcccaagggaattgttctcgtccaaaatgtccataagcggcggtttgacgataaataggttggattaaatccagcattttaattaagccataaggacgtaaatcaaaaaattcacgaatcagagcaaccagtaattcattggcaacttttcctgtaccaaaagtttccaccataatcgacgttggttccgctacaccgatagcataagaaagttgaatttcacaccgatcagccagccccgcagcaacaatatttttggcaacataacgagcggcataagctgccgaacgatccacttttgacggatctttacctgaaaatgcaccaccgccgtgtcttgccgctccaccgtaagtatctacaataattttacgtccagttaaaccgcaatctcccattggaccgccaataacaaaacgaccggttgggttgataaaatatttcgtctcttttgataaccattctgccggtaaaatcggtttaataatttcttccattaccccttcgtgaacagttttttgatcaacattatcagaatgctgagtggaaaggacaactgcgtcaattccgacgattctattatcttcgtatttcaacgtaacctgacttttggcatcgggacgcaaccaatctaatataccttttttacgcacttgtgcttgacgttccattaagcggtgagcataagtaatagcggcaggcattaaaacgtcggtttcattcgttgcatagccaaacataatcccttgatcaccggcaccttgatctaatggactttcacgatccactccctgattaatatcagaagattgtttaccaatggcatttaataccgcacatgaatgcccgtcaaagcctatgtccgaatgtttatagccaatatcgcaaattacttgacgtgttaagttctcaatatccacccaagcagaagttgtaatttcaccgccgactagagccatacctgtttttacataggtttcacaagctactcgagcttttggatcttgtctcaaaatctcatcaagtactgcatcggaaatttgatcggcaattttgtccggatgtccttccgatacagattcggaggtaaataaataagatgacatagattttccttaatggtagaaatttttattaatattttttttagatgttttaacgtctagacggctatattacgcttttttaattaaaaggcaagtcttaatttaggttgtataaagggacagattgtgaaacaatctgcaaattattcggcattgtgcggacaacaatattttcatttcaataatttaacaattctcaaaaaagaaaatatattggttagcacctacttcatgtcaaggttattaaaaattaacaattaattaaggtgaaggagagtgatcgatttcgatggatatcgccctaatgtaggtatcgtgatctgcaatgcagaaaggcaggtgctttgggcgaaaagatatggacaaaactcttggcagtttccacaaggtggcataaatgacaatgaaactgctgagcaggcgatgtatcgtgaattatatgaagaagccggtttaacaccgaaagatgtcgagattttatatgtttcaaaacactggctacgctataaattaccaaaacgcttacttcgtcatgataaccgaccaatttgtatcggacaaaaacaacgttggtttttattgcaattggtttctgatgaaaaaagaatcaatatgcagcacacaaaatcaccggaatttgatggttggcgttgggtcagtttttggtatccggtgaggcaagttgtcacatttaaaaaagatgtttaccgtaaggtaatgaaagagtttgcattgtttttatttgatacaaatttaaaatctcgactatctgtaccggaagaaaaaaaaatgttttcatcggttaagaaaaaacttattcacaaaaaaaatcataaatattcttcaaatcagtgagggggataaaatgttaaccttttttctcatttgtctaggtgtaggaacctttgcagggtttcttgctggattattcggtattggcggaggactcattattgttcctacgcttgtgtatttacttccgatggttggtgtgccggatcatctgctcatgtcaaccgcacttggtacgtctttcgctacaattgtcatcaccagtttttcttcagcacagcgtcattacaaacttggtaatgtagtttgggatgcagttaaaattctcattccaactctgatgttatcaacgtttgtttttaccggtattgtcagtcaattagataagagtttatccagtaaactctttgcagttttagtcgcttatatggcaataagaatggttatttccactaaaattcaaatcaaaaatactaaaaaactcactcctttatcgtcagttattggcggcgttttaattggtattgtgtccagcattgcaggcattggcggtggcggatttatcgtaccgtttttaaattctcggggtgtagatataaagaaagctattggatcttccgcagtttgcggcatgctattagggctatcgggggcactcagttttatgcgtagtggttggggcgttactgaaatgccggaatattcgcttggttatgtctatttacctgctgttttaggcattaccatcacctcattttttacgtcaaaaataggtgcaactacgacatccaaactgcctgtacctacattaaaacgctatttcgcaataatgctttgtgtgattgcacttaatatgctttttaaataaggaaatttaatgaatacattttttcaaatgccctatattgatcctgtcatgtttagcttaggacccgtcagtttacattggtatggtgttatgtatttgctcggttttggttttgcttattggctcggaatggctcgggcgaaaaaatcaaatggagtatggacatcagaacaattggaacaattattatacaacggatttcttggcgttattttaggcggaagaatcggtgatgtgttcttttacaacgttgataagttttttgctgatccactctacctatttcgtatttgggaaggtggaatgtctttccacggtggattaatcggcgtcattctcgcaatgatttggacatctcgtcgccaacgtcgctgtttttggcagaccgcagattttgtcgctcctttaattcctttcggtttaggcatgggaagaattggtaactttattaacagcgaattatggggaagagtaacagatgtaccttgggcaatcattccttacgcttcaaccacacctcgacatccatctcaactctatgaagcctttttagaaggtttcattttattaatcatcttaaatctctatattcgcaaaccacgcccaaccggttccgtagcaggattgtttttaatcggctatggtatcttccgtttcctagtggaatatgtacgagaaattgatcacaacgtaaataccattgatgaccttctcacacgagggcaattactctgtttaccaatgatattcggtggacttgccgtgatgatttggtcttattctcgttcaaaggcaaataaaagtgcggttaaaaaagggtaaatttttatgcgtcaatatttaaatttatgtcaacgtattattgatcaaggtcattgggtcgaaaacgaacgcacggaaaaacgttgcttaacggttattaacgccgatctcacctatgatgttgcaaacaaccaatttcctttaattacgactagaaaaagttactggaaagcggctatcgctgaatttttaggctatattcgaggctatgacaatgctgctgattttcgtaaattaggcactaaaacatgggacgcaaatgccaatgaaaatcaagcatggctcaataatccggtacgtaaaggtacagacgatatgggaagagtatatggcgtacaaggtcgtcgttggcggaaaccgaacggagaaactgtcgatcagctacgtaaaatcgtcaataacctgagcaaaggaattgatgatcgaggagagattttaacctttttcaatcccggtgaaattgatctgggttgcttacgtccttgcatgcacactcacacattttctttactgggcgatacactttatttaaccagttatcaacgttcatgtgatgttccgctgggactcaatttcaatcaaattcaagtattcacattcttagcattaatggcacaaattaccggcaaaaaagcgggacaagcctatcataaaattatcaatgcacatatttacgaagatcagtttgaattaatgcgtgatgtacagcttaaaagagagccttttccgcttcctcgattagaaattaatcctgatattaaaaccttggaagatttagaaacttgggtaacaatggacgacttcaaagtgattggctatcaatgccatgaggcgattaaataccccttctcagtttaaaaaataggaaaaacctcaacagtgcggtctgattttgatgaaaaaatgatgcgttatgccttatctctagcggataaggcggaggcattgggagaaattcctgtcggggcggttttagtggataaacaaggcgatattcttgcagaaggatggaacctatccattattcacaacgatcctaccgcacatgcagagattattgcattacgccaagccggacaaaaattacaaaattatcgtttacttgacacaaccctctatgtcacgctggagccttgtacgatgtgtgccggtgccattttacacagccgaatcgggcgtttagtgttcggtgcttatgactataaaacaggtgcggtcggctcacgctttcatttttttaatgattacaaaatgaaccatatgctggaaattacagggggcgtgttgcaagaagaatgtagccaaaaaataagtacattttttcaaaaacgtagaaaacaaaaaaagcatttaaagcccaactttaaacctttcctttaattcttgtaactgatctctaattgcagccgctttttcaaattctaaatcttgggcaaatttatacatctgttgctcaagttttttcacttgttgttgatagtccttaggcgaatttatcttttgataaagtgcggacgattccgccacagttttagcacgagcctttgttttacttttcgttatagcaccttgcccaatatccagtaattcgcccacttttttatttaaagcctgtggcacaacgcctttttccgcattgtatttcatttgtttttctcgccgacgatgagtttcatcaatcgctttttgcatagatttcgttatgctgtctgcgtataaaatcgcttttccgtttaaatttcgtgccgcacgaccgatagtctgaataagagaacgttcagaacgaagaaacccctctttatcggcatctaaaatcgcaactaaggaaacttccggaatatccaaaccctctcgcagtaagttaatcccaactaatacatcaaattcacctaaacgcaaatcacgaatgatttcaacacgttcaacggtatcaatatctgaatgtaaatagcgaacccgaataccatgttcttccaaataatccgtgagatcttccgccatacgtttggttaacgtggtgaccaaaactcgctcattttgctccgctcttttccttgcttccgataacaaatcatcaacttgaatcgctacaggacgtatctccacttccggatcgagtaaaccggtaggtctcacaacctgatcaataatttcatcgcccgatttttccaattcataaggccccggtgttgccgaaacgtagatagtctgcggtgctaaacgctcaaattcttcaaaacgtaatgggcgattatccaacgccgaaggcaaacgaaaaccgtattccacaagcgtttctttgcgtgaacggtcgccacgatacataccgcctatttgcggaacagtgacatggctttcatcaataattaacaaaccgtcacttggaatataatcaaataacgttggtggcggctccccctcatctcgccctgataaataacgtgagtaattttcaatccccgaacaatatcccaactcattcatcatctcaatatcaaattgagttcgctgagttaatcgttgttcctctacaaggcgattatttgccaacaaatattcacgacgtgcctgaagttccaacttaattttttcaatcgcctctaaaatacgttctcgaggtgtaacataatgcgttttaggataaatagtatagcgaggtatcgcaccaaaattcgctccagtcagtggatcaaataaactcaaacgctcaatttcatcatcaaataactcaatacgtactgcccgatcatcagattcagccggaaaaatatcaataatttctccccgcactctaaatgtccctcgttgaaaaacctgatcattgcgggtgtattgtaattctgccaatttcgccaaaatttggcgttgatcaacaatcgcaccatgttgcaaatgcaacatcattttcaaatagctatccggatcgcctaaaccgtaaatcgcagaaacagaagcgactacaatcgtatctcgtcgctcaagaaaagatttagtcgcagacaaacgcatttgctcaatttgatcattaatcgaagcatctttttcaataaacgtatcactactcggcacataagcttccggctgataataatcataataagacacaaaatattccaccgcattttccggaaaaaaagccttcatttccgcataaagttgagcagccaaagttttattaggagccaacaccatagcaggacgattcaatttcgcaatgacattggcaatcgtaaaggttttacctgatccggtaacgccaagcaatgtttgatgtgctaacccatcattcagattctccgctaattttgcaatagcttgtggctgatcaccggcgggttgaaagtcggaatgtaaaataaaaggcttactgttaattttgctcatagcaacaaaaatactaaaaaagggcggtgcattctagcataaaaaaacgtttctttactgacaaaaataggataagataacccgaatttttacttgacaaataaaatagaacagaaaaaatgacagtctacagtctacagtctacagtctacagtctacagtctacagtctacagtctacagtctacagtctagtatgttgcctaaaatcaacctttcaagttaaatttgagaggttggacatgttcaaacaatatcttaaaaatcacctatttcaacctcaacctttcggcgaagataccattcgcctttttttgttgtgtcttaaaaagcaaggcatttcctgtttaggtttataaccaactcctaaaaagtttactaaacaatcaatcaaaatcaacgcaagaaataattaatttaaaaaatccatttttaaagagaatagagatatgaacaaaatattcaaaaccaaatacgatattaccacaggtcaatgtaaagccgtttctgagttagccagcaatcgccaaatagcgagcagttcggagagtaagccgaagtgcggtgggttttggggtaattttttaagagcgtttaaggtccttccgttggcgttgttgcttgcgggatttttctctaattttgcttatgctgctaatgtttggttagaaaataaaaaagacttatcacaaaatggacagttaaatgaggggactggtgtttggtttgacggttcaaatatggaaaacccgagcaaaactgagtcaaccatcttatcgagtggagaaaattcaacaggagaatttgctcaaaaagctggttttaaaaataaaagttttaataggacagtcgtaataggctcacgtgccgttggaggcggagatgctactacggtaataggttatagagcaattgcaggagcaaatttatctgaaagacataaattatcttcgcaaggtacatcgataggttacagaacatttgctagaggggaaggggctactgcaatgggaaatgattccactgcatggggagataacgctattgccattggttctgataatgcgaaagcaacaagcacttcacaaatagacagcagagcagaacgtcctttaagtagagatgtttggaatcttgtacacagcaaaagaagtgattttctttatacagatgaatacgcaacaacatatcaaaagttggatacttatgacaagtatttaggagtaaaagatgattctgaagcatataagctaaaaagatcccacacatgggcaaggggacataactctatcgccattggggcaagaagtatagcctacggcgataacagtacggctatggggacgttagcgacagccatcggtaactactcgacctcgttgggggcattttctatggcgtttggagatcgttcgattgccatagggaatgaaagctatgtgtatgccggcggaagtgtcggggttggtaatgaggtgcaggcaatcagtgatggtgcgatggtttatggcttggaatcttatgcgggcggtgatggttccattgccatagggaaacgtgctttagcaaacgtagaaatgggggatatgtttaagaatgctgttgaaaatggcaagaatttatacgaagcagagagtactttttcaaagttaggcgaattagataatagcgttcaagattactttaaaccaagcactgagtatcagcagggttccggggaacacaaagccaaacgaaataaaaactcaggcaagcaagatgctacaggcggtttagccattggttactatgtatccgcactaggggaaaattcattggcgttaggtcgtcaagcctatgcgaaaggcgatcgctccatggctatcggtccttatgcstatggtgctraggaaaaaacwgcygcactrggttatrgatccaaggctataggaraacaatcaatggcgttaggatcgctrtctcgtgcagaggggmaaaacagtatcgctattggggtcaatagtgcggtraaaaatgaawctarywstawwaaaagaaacggtswaaacacgatagccatcggtaaygaaaccgaagcgacsatggataactcmgttgcsttgggytataaatccaccacaaaatatttttataataagagtgataacagtaccgccacgttaaacggagatgaagccattagtttgccatcctatgcaccggaagggacaagctataagttacaaaccgataatgcggcgggtatcgtgtccgtcggttggaaaaaaagcgatagtgaacttggtctaagaagaattgtcggggtcgccgcaggagcattggactccgacgtcgcaaccgtgggtcagttaaaagccttgtattacgtcaaaaaagaaggggtagtcacttactataccaaagaacctgacgggaaaatcaccaaactcaccaaagacggcagtaagttttatagagtcaacaccaaagacggcacgccttataaagagttgcaggaagttgatgcaaaagatgttttcgtcggtccaaaaggggcgaatgaagaaacaagagaagaaatgaaagacggcaaaaaatattcccttggtaatatgggtaatctaattaaatttgccaatattttagatggagagatttctgcgacttccgatcaggcggtaacgggtggtcagcttaacgatcttaacggcaaattaggattgacactaaatagcaaaaaaacaggctttgagaaagtccaatttgatgcagtagaagtagctgatgaaaacgttaaaaaaggaaaaatagaaaatttcaaagaagccttgactgactctatcgctgcaattaatagaggttataaatttattgatgacaactctcaaaattcagacaaagatacacctttctatctcggatcaacaataaaaattgtggcaggaaatatttctgcacaaccgaatagcaaacctcaagaaacatatttaggtaaaaacctcaaaacaaaatttgaaaaagagccaagcaacaattcaatcgctaaatttacgattggcttaaaagacgatccgacatttacaaaggtatccttagaggcagaacaaacatataattctgacccatcaaaaaatacagtcaaagatacaaaagaacttatcactaaaggytayttrgacggtgcattarmaaacgtcgcctcaagtttcacggttaagggagatgatamaagtaaatcattkarcattgataaaartmatacgactttaactattaaaggcggaaacaatattaccacagcrgttgatactamccaaaaagccttaaccatatcrytkaawgagrstttaacagryattacctcrattascggtaaaaatggtagcggaagtaacrgaagtgcggtarcaaaaattgartttratagcactgcaagcggtagcaacgcttcaaccccgaaygtcaaaatcaccrcwggyggtrgcacatttayctttagtgaaaacggcttaaatttgggtagcaaaaaaatcactggtttagcagagggttcagacgacaccgatgccgttacctttaaacaactaaaagattcaaaattgcactttttatcggttaaagccccgacaagcccagagtcaaaaagcaattacaataatgacggtgcaaaagctgaaggggcgattgcgattggtgtggatgcgaaaactgataaagcaaatgcaattgttatagggaatagtgttactgttgatcaagaaaaatcaatagcgttagggaatgatattaatattaaacaaagtaaagcaggatattcaactgttgcaataggtaacaaaataacaatgaatgaatctggtggttctattgttttatctgctatgaatcaatggaatggtcctgatgatggtataacactaaacaatgttggttggggtgttatattaggaaataaaaccaaaatagagggcggaaacgatattgttgctttaggtaacaatatgaatgtgactaggagtaatggaagcaaacacgatctaaatagcaatttgatcatcttaggtaatggtgcaaaagcccatgatgcaaaagaaagtgtggtgattggtaatgtcgcagacgtgaaagcccaaagtgcggtagcgattggtaaaggagcgactattgaagccaatgccacaggtgcggtagcgattggggaaagtgcgactgtatccactaacgctggtgattccattgcgttggggaaaaattctaaggcggaaatgaaaaaggccgcaccgactggatttacggttaatgcaggggcaaatgacctaaaaattacttggtccagtgcaggggctggtggaagcaaatctgtggtgagtgtcggcgataaaggtagtgaacgcataatcaccaacgttgctgcaggtaaagtcgatacagattcaaccgaagcggtgaatggcggacaattaaaaagcgttatcgatgtctttgctaatttgggggtaactgtactcggggcggagaaaaacgatactggcgatggctttaagaaatccaagtttgatgcggtgaagactggcgacacagtaaattctcaagctcaagtaaaatctgagaaaccctttaaaacagccattgaagataatattacagccatcaacaaaggcttgaaatttgctggcgataacggcggcgaagcgaagcaactctatctcggttcaaccttaacgattaagggagcgacaggtcctgcttcaaaaccaacaacaagtgcggggcaaaacggtgcaggtactcatcaaaatatctttaccacagcgaaaaatacaggcattttggaaattgctttgaatgaagagttgaaaggtattaaatccgttgctaatggagacgatgtaaaaattgaattaaaaactactggaactggtggaaatggaactacaaaatctatcgttttcacagctggcgatacaaacaataaagtaacgctaactggcaataaattcagtggcgtgtctgaaattagcagtaaagacagtaaatctaaattaacacttggtgctgataacgcaactgtagaattagaacatggcaaatcaaaacttgaactaaaagatactgaagcaacaatcacagcaggaactgatgctggaagtattaaaattaacaataacggtgatacgaaaattgagttaagtcctgaaagtggctctacagttaccttggcaaaagacagcacgaatggcgtaaaagccacaggtttatctacagttgggttagatggtgataatactttagtgtttaaaaatggtacaaatagcactaacacggcggagttaaaagtcggtggtgcagctttaacattcacctctactggaaatggaactggcggaactgctcaaaccgtgaaaatctctaatgtggcagctggaaaaattgatactagttcaaccgaagccattacaggtaaacaacttgctgatttagctactcatttaggggttagtgttgatagtggaaaaactgggtttacagcaccatcatttgaagttatcaaaggcggtactaaagacgcaacgagcggtaagaatggtcctacaacctttaaaggagcgattgaccagttaatcaccgcagttaatggtggtttgacattcaaggggaatgataacagttcgactaaattacaattgggcggtactttaaccattgatagctcaacggttggtagtggtagtgaaaaagacattacagcaaaactggaaccgtctaatggtaatgattctaaagatgcagggaaattaacattaacgttaaataaagctacttctgtagataaaaatgacgaaaaagtcattacctcaaaagccgtagcaacggagttggaaaaatatacgaaaactgctgatttaggtaatgcgtatttgaaaatagatggatcgaatattggcgatgcttccaataaaaaaacattcggtggtmatgtcggtattgctgaaatcaagttagatggtgaaaaaagcagcactgaattagtacaggcggatgcggttattaagtayctaaaaggtacaggaccagattctgtaaaaatatcagactcaacaaagacaatggctaaaggaaattactcaataagtataggacatgaagccgtatcagaaaatgcagaatcaatagcgataggatatatgactcatgcacaaaataaaaaatcgatagcattaggtaatgaaagtgaggtattgggcgagaaatctattgcaataggtacagagaataaaatagatggtgagggtaaataytcarcmgtattaggmrtagagaataargtatcwagymaatttasttattyartaggatacmayaatgatatyaaaggagataatacctttgtattaggatctaayatatyaacagacaattctattaaaaatgcartaatacttggagatagatcaaaagswgaagcaaatgcggtatcwgtrggtrgtgctggcgatggtgaacaamgaagaattgtttatgttgcyamwccaacgrrtaaataygatgckgtgaataaacaatatgttgatggacttggattaaaattcaaaggtaatgataaymaagagatacayaaaaaattatcasamacwttagaaatagttggtaagggtttaaataaagctcaaactactaaatttaatggaacaaatggaaatattgctgtaaaagaaaataaagggaaattggaaatatcattaaatagagatttaaaaggaattaaatctattagtgatagaaagaataaaaatatagctactgaaataagattcaatagcaaaaatagcacaagcagtattcctaacagtttgacaaataacctaactatttcttcaaatggaggcacatttgaatttaatagaacaggtttgcatattaacaataaacaaattacagggttaagaagtggactattagaaaaacataatggacaagatagagaaagaaaagatttaaactatttaataggagatgaatttaaaaattcctctattcaaactcatgcagtcaatgttggagatttagcgaaaatttctaaggaaatagttgaaaaaggatataagtataaagctgatattccgtcaaataatagcaatgataccagcataaaactaggctcaaccatatctattgttaaatggacagacacaccggcgactggacaaccagcagtaactgttggcacaggaacaacttctcaaacatcagctgttaagtacacaggagataatttaacaactcgatatacctatgacagtagcaatggcaacgctaaaatcgaaatcgggtttaaagacgcaccgacatttagcaaagttaccttatctcaagctcaaacatatggtaagggtagcagtgttggaaataacgacttgattagcaaatcctaccttgacgctgcattaaaagactttaagtttaatgtggaatatggtggtaagcaagtccaaatcggtcgtggcgatacgttgaagtttgcagacgggctgaatattaaactggagttaaaagaagtcgaaaaaccggcaaatgaggcaacgtctaccattaattcaaatatggaaacttctaccccagcaccaacaacagtaagtaccccatcagatggtgcaaatgatgcagacgtggctacaacaacggcagaggtaaccattgacacgactgaggaattgaaaaacatcacttcgatttcctctaaaggaagtgcgggcggaaatgatgctgactcaactgtagaagtcaccaaacttaccttagaagctgataaaggggcgactttccgagtgggcaacacgggtgctaaagtgaatgtcaatagcgatggtatttccctcacaccgaaaggggcaagtggtacgagtccatctgacgatgtagcatctatcactattaaagcaggctcaaaaccagtggattcaaacagtatagatttacttgatccagctaacggaccttcaatagcgtttgcagccaaaggcggtagtaatggctcaaaagagggaactggtacaattaaatacctcaaagacagaactgttagcaaaaacaatggcaacggcgataaatacggtgagggcgataacaaaggcaacgcagctacagaaggggcggtgaaagagctttatgaatccggtttgaaattcgccggcaatgaaggtgagcctgttcacaaaaaactgggtgaaaccttgtctattaaaggcgaaggtgcggttggtgaaacggcgacggataacattgtggtaagagccaaagagggtgaactgcaaatcggtctgaccaaaaatattagaaatattgacaccatttctatcgctggcacaggggacaatagcggtaaagatgtctttatagatgctgagggtatgaccactactgctcaacttgaagatggcacggtgttggtgaataaccaaacggctgaaggtgtcagtacaatagctaaaaaagaggatggtagcattttggtgaataatcaaacagcagaagcgaatattttaagcaatggcaagcacacgacagaggtgaaagccggtgaggtcgctattaaagacaagagcggtcaagaaatcgtgagcttgaaagtggctgagggtgaaaacggtcaagatggcaagggagcgacgcttgcgtttgccaaagatggcgaaaacggtacaggcgtaatcatgggcttgaaagacctagatgccactgctgacggttcaagtgcagcgaataaaaactatgtggatgaaaaaatgtccgatttggacagcaaccgtccgtttaacttctatatccaagagggcaaagagtataccaaagtcgtcaaaggacgtgatggtaagttttatgatcctgagcttttacaaggggcaaagtatgatgtggacagcaagaaatacattgctcaagatggacaagaagttacaccggaatcggataaagtcattattcgtgctgaaccgactaccgcacctatcgggattaataatgtggcaagcgggttgggtattttggctatagaagaaagcgagaaacaacaacttacgcaagctgttgaagataagaaaaacaaggtaagcgaaagtgaaaaggctcttgctcaaactactgctgatgttaaaagtaaacaacaagcacttactgaaaaaacaaatgagctttcacaagttgccagcgaacgtcccgtattgttgatgcaaaaagctgaccttgagcagcaacttaaaggattgggtgcgagcgatccacgaagagcaaccgcacaagccgcacttgataaggtaaaagaggctcttacacaaaatgatcaaaaggtgactgaggcgacaaaaacagctaatgaggcttccgaagctctcaaacaagcgaaagtcgctttggcagacaacgtgttaaaagcctatgcagcacaacaagcattagctactgccgaggaaaccttgcgaaataaagaatttggcgtggataaggtgaaagacttactgtcaggcagttcaaatattgctgaggataatgtggctactattaaagatgtgaaagcacttgctaaagcaggattaagttttgagggcaatgatggtaaacgcttgcataaagatctatcagaaactttagcaatcaaaggtgaagaaaatgcaagtggtgataaatttaatagcaaccacaccgccgccggcaatatcaaagtggaaatggcacaagacggtaaaggcttagaagtcaaattgtctgaccagttgaagaacctcacatcggttgaaactaaaaaagacgaccaaggcagatcaacaacattgctgtcccgtggagtgatggttcaaaatgacaccacaaaagaacaagcccagttcagcgaaaaccgtttagcgttctttaaagatggagcgttaggattgaatttagacggtaagtctcgtgcattgaaagtcggtgaaaaagcgatcatcagtataaacgacaaaggtgaagcattggtttccgatctgaatgaatttagttcaggtatgacaattaccaataaaaactatgtggataccaaaaacaatgagttgcgtacgcaattgaataatactgaccgcactttacgagcaggtattgccggttcgaatgcggcggcagggttggcatcggtctctatgccgggtaaatctatgttagccatttctgcagcaggttatggcggggaaaacgcagtggcaattggctattctcgcatgagtgataatggtaagattatgctacaactgcaaggaaatcggaattctagaggcaaagcggcgggttctgtttctatagggtatcaatggtaaattgattcgattgtgccttatgtccacattttgttgttgaggatataaggcataaaaagcgtgctctgttttaaaatcaacttggtaattgttgttcgatttattgatgagtcattaagtttggtttctttttacatagacaaggtttaaaatggattagattctgttttaaaccttttttacaattggacaaatcttttaatatcaagaataactgtctgtatctatttcaaatagctatattgctatctatgatgatggaatattgctcttgatgtttgtagcaaaaaattacatagactttaaacgaggagaagaaatatggaaaaattcgatgttgtgattattggtgcaggaccttccggttctgtttctgcatcattattgcataaacaaggcttaaaggtttgtgtgttggaaaaacagcatttccctcgttttgtcattggtgaaagtttgttaccttattgtatggatattttgcaagaggctgatttggttgaggcggtgcatgctgagaaaagttttcaatttaaaaatggggcggcatttacttggggaaatcgttacacctattttgattttacagataaatttactgccggaccgggaacaacttaccaagttcgtcggggcatttttgatcaaattttgattgatgaaacggcaaaaaaaggtgtagaggttcgttttggacatgaagtattagcttttgatcatcagggcgatcgggcggagctgacggtaaaaacggagcaaggggaagaatatcggctgagtgcaggttttgtgttggatgccagcggttacggacgtgttttgccacgcttattatatttagaaacaccatcgcacttgccaatacgtattgcacattttacccatattgatgacaacattgatgatccgatctttgatcgtaataaaattctcattaccacacatcctgaacatcgtgatgtttggctttggttaattccctttgcggataaccgttgttcaatcggtgtagttgggttaccggaaatattggcgggtgagagcgaaactgtgttgaaaaaatttgctcttgaatgtccaatgctgagtaaaattcttgctaaggcaaattgggaaaatgaatttccgtatcgccatattcaaggttattccgctaatgtgaaaacgttgcatggcaaacattttgctttattgggtaatgcagcggaatttcttgatccggttttttcatctggcgtgactattgcgttacattccgctcgcttggcaagtcgtcttattgctcgtgggcttcaaggacaagctgtggattggcaacaagaatttgcagatccgttaatggttggcgtgaatgcgttccgcacttatgtgaacggttggtatgattatagtttccaagatgtcatttatgcccgtaatccacaacctgaaattcgccaaatgctttcgtctattcttgccggttatgcgtgggatgagaaaaatccgtttgtgacgaaatcctcccctcgcttgaaagcacttgcggaattatgcggcgaggcaacacaagattaaaataacaatatataagcattcaaaaattgctatttgcaaacgttgagtgcttttattttttcataaggaaacaccatgccatcgtttgaaaatctttcttttattaccgcacttttatttttttgtatttgtctcattttattttttatttttgtacgtaagcaaagagaggtggaggcgttacaacaagagttagataaaaatattaatatttttaatcaattgctgaataaatatgaacgtataaaagacgaaaaaactcagcttgggcaacaagttgtaaaggcacagacacttgtcgaaaccggtcaaattcgtttgtcggaacgtgatgaaaaaatcctttatttgcaaaaagaattagataaagaacaattacggtgtgagcaagtttctcagctggtaacaggattgaaagagcgtttgggggtagtaagtacacaggcggaaagttttcaacagcagttaaatcaaagtcgtgcagaaaaagaaaagagagattgtgcttgggctgatttaaatcagaaacataccgcacttcaacaagaactgacagaattaaaagtcacgttaagtgaaaaagaaaaaaattttgtcgagcaacaacaaaatttttctcaggctaaacaactgttaagtgttgagtttcaaaatcttgccaatcggatcttggaagaaaaaagtcaacgatttaatcaaactaaccaacaaactttagacagtttattgaaaccttttcgtgaacaaattgatggttttcaaaagcgggtgaacgaaattcattccgagtccttgaaaggcaatgccagccttgaaagtgaaattaaaaaggtgttggatattgggttggcaatgtcgaaagaggcgaataacttaacttctgctttgaaaggcgaaaagaaaaccttggggaattggggagaagttcagttagagcgtacattgcaattagccggattgattgaaaatgagcattacagcagtcaagtacattttaaaaatgagcagggcaaacataattatcctgattttattttgcatttacccgataataagcatttgattattgacagtaaaatatctttggtagcttatgaaagtgcggttaattctgacgatgaaaatcaacgtaaacttggtttacaggaacatgttaaagccttgaaaaatcatattgacgatttatctcggaaagattatagcaatttgattggtatgcgtagtccaaattttgtattgatgtttgttgctgttgaagcagcttatattgaagcgatgaaacatgacagtaacttatttaattacggatatgaaaaaaatgtcattttagtttctcacacgacattaatgcctattttgcggacggtagcgaatttatggcgaattgagcgtggtaatcttgaggcaaaagaaattagtgcaaaagcaggtgaaatttataatcaaatttgcgtagtggcagagcgtttaaataaattaggtaacagtttatccggtgtaagtaatcattataataataccgttaccgcacttgtaggacagcaaggtttggtggggaaagttgagcggttcaaggatttatccgctaaggcgaacaagataatgccggagattgaattgttgcataatgatataaacgttgagaaattaattgccgttcaagctgaagtcgaagagaaataggatttttaggtaaaaatcttttaaaataatgacagttttgacataagagggaatacattatgattattgttacaggtggagccggattaattggaagtaatatcattgcggcattaaacgatatgggacgtcgagatattttggtagtggacaacctgactgatgggacaaaatttgtcaatttggtcgatttggatattgcggattattgtgataaagaagattttattgcttccattattgccggtgatgattttggagatattgatgcaattttccatcaaggcgcttgttctgctacaacagaatggaacggtaaatatttaatgcaaaataattatgaatattcaaaagaactattgcattattgtctattgcgtgaaattcctttcttttatgcctcaagtgcggcgacttatggcgataaaacagactttattgaagaacgccaatttgaaggtccgttaaatgtttatggctattcaaaattcctatttgatgaatacgtgcgtcaaattctgccacaggctacgtcgcctgtttgtgggttcaaatatttcaatgtatatggtcctcgtgaacaacataagggttcaatggcaagtgttgcattccatttaaataatcagatgttgaaaggagaaaatccaaaattatttgcaggatcagagcattttttgcgtgattttgtttatgtgggcgatgtggcaaaagtgaatttgtgggcatggcaacatggtatttcaggcatttataattgtggaacaggtagagcggaaagttttgaacaagtagcaagagcggtgttgaattatcatggcaaaggtgaaattgaaactattccgttccctgagcatttaaaatcacgttatcaagaatatacacaagctaatttaacaaaattacgtgccgctggttatcaagcagaatttaagtcggttgctgagggagtagcggaatatatgcaatggttaaatcgcaagtcttgatttagcgaggaaaatagtgttaaaagtgcggtttaattgggtgttcatttattcggtattccttttaaatctgcaactaaaaagactattttgctttataatatcggcaatcttcactgttattggtcaaaacctatgaaaattctcgtaattggaccttcttgggtgggtgatatgattatgtcccatagtctgtatcaaaccttaaaacaacaatatcccgattgcctgattgatgtattggcaccgaattggtgtaagcctttacttgcacgtatgcctgaggttcgcaatgcgattactatgcccattgggcatggttcctttgacttaaaaggtcggtatcgaattggtaaatctttgcgtaatcaatatgatatggcgattgtcttgccaaattccttgaaatcggcttttattcctgcctttgcgaaaattcctgtacgccgtggttggataggagaaagtcgttattttttgttaaatgattggcgtcgcaataaaaacgactatccgatgatggtacagcgttatgtggcattgggttatgataaaaccgtattgccgacagcaaaacatttagccattcctaagccttatttgcaagttgatgctcaagagttggaacaaactttagaaacttttgcaaaacaaaccgcactttgtacaaatcgtccggtaattgggttttgtcctggtgcagaatttggacctgcaaagcgttggccacattatcattacgccgatttagcccgacagttaattgaacagggctatgccgttcgtttattcggttcggcgaaagataaagaggtaggtgagcaaattagtcaagcgttgcctcaaaaattacaacattattgtgtaaatcttgctggtgaaacagacttaaatcaagctgttgatttgatttcagattgtgtggcagtagtgagtaatgatagcggtttaatgcatattgccgccgcacttaacaaacctttggttgctgtttatggaccaacaagtccggaatacacgccgccactttccgacaatgctgtgattattcgtctaattgagggaggcttgattaaagtgcgtaaaagtcaagatagctcggaaggttatcaccaaagtttaatcgacattacaccgcaaatggtcatcgaaaaattacaggattttttaaattaatatgaaagtttgtttgattaaaaccagctcaatgggcgatgtaattcatactttgccagccttgactgatgctcaaaatgctattgctgatctgcaagtggattgggtggtggaagaaaattttgcggaaattccccgttggcattcagccgttaatcatgttattcctctagcaatacgacgttggcgtaaacagcttttttccgctcaaacaagaaacgaatggaaaaattaccgcactttgttacaacaaaatcaatatgatgcggtaattgatgctcaagggttagtgaaaagtgcgttgtttggagcgagtttagcgaaaggggtaaaacatggttatgatcgtcattctattcgtgagcctttcgcctcatttttctatgacaaaaaatatactatttcttatcaacagcatgctgttgaacgtattcgtcaattatttgcccaaagtttaggttatgaattgcctcacgaaaaaggcgattatggtattgcgaagcattttgtgcattcgactgaaaatgcacaacattatgtcgtttttgttcatagcactacaagagcggataagcattggctcgatgcggaatggaaaaaattagcccaaaaattgaccgcactaggtttgcaaattcgcttaccttggggtaatgaaaaggaaaaagcacgtgccgattggattgcacaagatattcaaagtgcggtagttttaccaaaactttcattgaccgagttggcacaacagattacctatgcaaaagcggtagtttctgtggatactggattagcacacttgactgccgctttagatgttccgaatattactttatatggagcaacagatccgaagttgatcgggacgtatggtaaacatcaacattatattcagaaacagggtatggcgttgattagtgcggaagatgtgttgagtgaattacagtcaaaagaaatattgaaattttaaccatagaacatctgcactttgcatttacactaagtgcagatgaatttgattataaacggataacgccgtcataaatatgtgttgcctcgccggtcatataaagtgggtgtccttttccttgccattcaatcattaaccttcctcccggcaaatcgacttgtacgcaactacctaaaacgccctgcataatgccaacggcaactgctgcacacgcaccgctgccacaggcttgtgtttctcctgctcctctttcatacacacgcagtttaatatgattgcggttgataatttgcataaaaccggcatttacacgttcaggaaagcgttcatggctttctaagagcggtcctaatatttcgatgtttgcgtgttgaatatcttccacttgtgttacacaatgtggattgcccatagataccacaccacatagcaaggtttgtatgtctgtgcgaataatataatttttttcaaatttattggcgttaaaagggattttattcggttcccaaatcggttcacccatattgacacataccatgtcatcgtctttaacgcataacatcattttgccttttgcagtactcacggcaatttcttttttattggttaaacctttaagcacgacaaaacgagcaaagcatcttgcaccattgccacattgcgaaacttcactaccgtccgcattgaaaatacgatagtgaaaatccaaatccggatcataaggcggttcaacgactagcaattgatcaaaaccaatcccacgattgcgatctgccaatctttttatgacttcagtgggaaaataaacgttttgagtgacagcatctaccacaacaaaatcattccccagtccatgcattttggaaaattgcatttcctcttccttaagcaaattaaaattggagctattataatcagctgcttaaattgagtaaatgagagaaatcattcactcagattgtgaaattcatatttttttctgcaaaattgtatcgtataattctccgccagtttaaaaagataaaattaaactatttaaaaaatttatttctttgatacataaggagtttttatgaaatacaaattatctttagtacttttggcaatgctgcccgcactttcccatgcgggggggggaattttaacttttacggcaaagcgggaattgatttaacctctcgttttgaaactatgagaataattgcaaaccatgatggtaaccctcccatttcagcaagctcaagacaaaatactttctcgccaagcatcttttttgaaaccacttataatattttaccgcaaacagaaatcggtctaggattaggctatattaaacgcaaaggctttgagcattctgcaagctggggaattcatggaggaggagagtatgcaccgatttcagataatactggaatcgaaacctataaaatacctcgttatgcctccctgccaatttattttattctaaaacaagattatgccctaagtcgaaatacaaacctgtatttcaaagcaaatttaggttattcaatcaataaaatttccaatacacaatataagtattatacagatctagagcaagaaaacgtttttaaattatcggagtttcagagcgggttgcgtccgatgaaagtgaaaaatggtctttatttaggtttaggattggggattgaatataaagctttcttagcagaaattggctattatcataccaaatcaaaagtaactcgtaaaaactataactatgagattagaaactcgatctacgaaagtacctcttacaataatgatgccatacgtttaacccttggggttaaattctaaaagtaacattctctccgcactttgaggcggagagaatgttaagttgttgttttataccacgccaagataaatgtagcaatttgcgttgggttgttaatatccagtaaaggaacggaagtttgtacgggatagtccgttgctaacgctattacatattcatcacaaggcggacaaggtttcgtcatgtcttgacgatgtactaaaattttgacaataggctcttgtttaaaaccttccactaaaattaaatcggtcatttggggtgaaaattgttgagcgagataatctaaagtgagcgattttggcgtttcggtcatcaatgcccaacgcttatcacatgccaacataacttgtgtcgcaccggcttctttcatacgccagctgtcttttccctctttgtcgatttgtgcgttatgatggctatgtttgatgactgaaacccgcaaacctaaacggagcaattcaggcagtaatttttccaataatgtggtttttccgctaccgctataacctgtgatacctagcatgggttgcatataaattcctcttttattgaataatgcgtaacagaatgggttgaaaagcctttttatgttgccattttttactgtatgaatggataagcacaaaagaaagtgcggtacaaaaaaggataaaaattgcaccccacaattcttggctaaaaatttggtttgcaatgagtgttgcactgagcaaggtcattaaaggaataatatacaataaaagtgcggtagaaatcagagaactttcttgtaaaccaagctcaacaatttgacctatttttaagggtatcaggctattaacgataaagatatgctccggacttttgccggttaattcagaaagtgcggaagttccgcaagtattttttgctgtacattggctacaagcatttttgctttgacatttcactgttgcttttccttgatgataggcaatgactatcgctctttctgttagcataaaaaacctatttaattcgaatatcttgaataatacgtttagcggaaaagagaggaagttgaccgacaaaggttaattctttgttacctagagtgttgctgtaaaaagtggtggagccttgcttccaaaatctttctccgtcattatcaacaatgctgttagacaaatagagtgcaaaagaaaatagtccgtcactataaaattggctctcaatagggtgtttattgtctttttctattgttatggattggctaattaacttaaacccttttgggagccactccggtttccaattttgttgttgagttttcggctcacttaataacggaggaaaaatgacattatctatatagctacctaattcgatcagttcatcaccaagatataaattaactactcggaactgctctaataaattgccttcacgatccaacatatcactgcgtagcaacaaatgattttgttcatcgataaagactaaatattgatagcgaaaatcgtctttaggcaaaatacgtaaagtttgtacaatgcgatccgccacacgattacgcccaatggttacgatatcgtaataatctgataattgcttaacatcactccacattacaacaggtaagttatccataatatgaccgctctttaaagagaatgcttggaaattaggtggaaaataactcactaaattttcatgttggataatttcttgttgaacaccatctaaggtaataagttgggcgtaacttttgccatcctgattaatatgacgataacgaagtgaatctatattggttggcgtggcttgcacaaaataaatttcataatttaatgtattttgtgctgcaatcattttttccaataattgctcaggttctatattttcttgagcgaaagttgaaactgaaaaagtaagaagtgcggtcaaaaaagagaaaatttttaacatagtattcttcctaagaaaaaaattcaccaccaaacggtggcgaatatcttaacatgaattgagctaatgttcattatttggcaatccgaaactgtcagtatgcagacgtcgctgtaattcatagttttgtagcattatgccaatacgtttgttccgttgttctacttgctcttgcgtaattatttcttttctcggaacattatagctgatttcttgtaccgaattattaaatggaagcgtttgtagcgttggggtatccagtgtatttttgcccgctctttcatgattaaaagattgaacgccaagtacggcaacgaaacaaaccgttgcagcaactgccatttgtaacattggggaaaagaatgagcgtattttttgtataaacggaagtttttccacttctgcgagtgtcggttgagactcgagagaatgttcgatttgtattttttcttcctgttcaatgagcgttcccattcttgctgtgaaatcagaacctaacagcactttactttctttgcgtataatggaacgaattaaatgataatttgaccaactattttgtaagtctttgttttgacaaagggtgtcagtaaatttgttaccacaatgctcaccatcgatataagctgaaagtaactctttttgcatctttaactccaagtctttgtttattaaactatttaacgttgtatcaaaggttgaattttgctttcgattatttctcttgcacggaaaatacgagaacgtacggttcccaccggacaatccataatttctgcaatttcttcgtaactcaatccttccatttcccgtagtgtaatagctgtttttaaatcttcttgcaggttactgatagtatcaaaaacaacttttttcaattcaccggataatatttcattttcgggagtattcacgtcccttaaatttgtaccaacattatagctttcagcgtcttctgctaatatatcctctgttggcggacgccgtccttgtgccgttaagtaattctttgccgtattaaccgctattcgatatagccaagtataaaaagcactttcgccacgaaatgattcaattgagcggtaggcttttataaaggattcttgtacaacatcgggaatatcgttttgtgaaatataacgagtaagtaatccagcaactttattttgataacgagcaaccaataagttaaaggcctttttatctccctgctgtactttttctaccaaagcctgatccgttagttgttcagccatataacctcttgtatcacatctaacaagccttaatattaaagccagccaacccctgtgcttgttagacgtaatggaataaaaaaagttcaatctttttaggaaagattattgatataaatttaaattttcttgaatatgatctaccatctcttgtaattcaagatcagcagccggagttttgttaaaaaaccaagaaaaaagttgtaaatccgagcaagctaataaacgcaaaaatatatcttttttagcatcaggtagttcatcaaaatattgttgaaaaaaaggcataataactttatctaattccaacatgcctcggcggcaatcccattcaatgcggaatttgttgtatttttccatgcttaatttccttttatctaattttcttgttaatagtaacaatcggaagaaacgctgtaaataaaagagaagaataaactcggttcggatagattttaggtgtgcaatataaatggcatacaaataaggcgtattatatatcaatacgcctttgctcttaggtgtaaatccctttaacttttaaccagctctactacttcacgggttaatcgtccaatttcttcccattgttgggacttaatcaaagatttctctacaaaccaagagccaccgcaagcaactacgtttggaatagcgagatagtctttgatattttgtggcgaaatgccaccggtcggcataatttgtaagttaccgtaagggccaagtaaggcttttatcattttaacaccgccacttgcctcagcagggaaaaacttgacagcttgtatgctgagttcaagagcggattcgattgccattggattatttaccccaggcgttacaggtatatttaactcttgagaatacttcacaatatttggattaaagcctggagtaacaatacaatctgctccggcatttttggcagccaatacctgttctttggttagcaccgtgcctgcagctatgagtacttcaggatattgttggtgaaccaatttaatggcctcttcggcagcttcggagcggaaagtaatttccactacaggcaagccgttttcagacaatgtttttgctaagggtaaaatatcctctgctttatctaaagcaataaccggaacaactttaagctgtttcaacttgtcaataatttgttcagtggtataacgcatttttaacctcttttttaatgtgaaaaaatttctttaaaatggttattttatttgaaataacgttttgcattgtcatagcaaatgtctttcaccatctttcctagcaggttgagatcatttggtgcttcaccacgttcaacccagccaccaatcatttcacataaaatacggcggaaatattcgtggcgagtgtaagataagaaactgcgagaatcagtcagcataccaacaaattggcttaatagtcccaattgtgatagctgttgcagttggcgttccatgccatctttttgatcgttgaaccaccagcctgaaccgaattgaattttacctgcaatgcccccggtttggaaattaccgatcattgtgccaagcatttcgttatcacgaggatttaagcagtataaaatggttttcgggagttggtctgtttgatccatgctgtctaataaacgagaaagtgattcagcaaacgcacgatctccgattgaatcaaatccagcatctgcacctagcaatttgaacattctcgtattgttgttacgaattgctccgatatggagctgcattacccaatggtgtttgtggtactccgtacctaaccaaactaatagtgcggtgctaaattgtgcaatttcttcttcttcaataggttgattgttaagtcttttttgcaatatttgatcaagagttttctcatcaggaattggtgagaaacggacaatttccataccatgatcagcagatttacaaccatatttatcgaaatgttcaatacgtttcgatagagcctgttttagtttatcgaaagtgttgatttcaatatctgcgacttttcccaactgctcaatataatcattgaacagaggaagctcaattttaaacgcacggtcaggtcggaaacttggtacaacttcaacatcaaaggtattatcttctgcaatggctttatggtattccaatgaatcaataggatcatcggttgtaccaaccaaatttacattcatttttttcataataccacgtgctgaaaactcaggctgttgcaataactctttccctttatgccaaattttctccgctgtttcaggtgaaaaaatcgtgtcggtaataccgaacggacgacgtaattctaagtgagtccagtgataaatcgggttaccgatacattttggtacagtgttggcgaatgcgagatatttactgtatttatctgcacttcccgtaattaaatgctcttctaccccagctgaacgcattgctcgccatttgtagtgatcgccttctaaccaaatttcagctaaatcattaaattggcgattttctgcaatttcttttgggtttaaatggcagtgatagtcaaaaatcggttgttcttcagcataatcatgataaagcttttgagccgttgaggttgatagtaaaaaatcttccgtcataaatttcatcattatgtcctcttattgagttattttttgttctaatatacttgcgttttcgtccactttttctttagaaagcgggtaaacgtatttcaacagtaaaaaaatcaagatgcaagccaatgcaggtactcccgttgcaaagttatagattgactctaacacttcttgtggttgttgtgggatttttgcagaatagccaatgtaacttagtgcaaagccacctaaaccaccagctaaagcttgaccgattttgcgagcaaatgaataaactgcataaattgtgccatcttcacggcgtccagttttgataaattggttatcaataatatctgtaataaatgcccatataataatttggaaataacttagacccagtgttgcaatgagtgcaacaatgataaataaccaaacatttgtgattttaacgaagaatagcacactgtatatgacagcagttatcaataaacctacagaagctgattcttttttaccgtactttttcacaatattttgggcaaacggagcaaccataaatgttgtcacggcacctaaaataccaccaaatgacaatgctaatttactattaaagtaatcaacatacaaatatgggttcattgtaccgatgattaaggttgctagcagtaaaatgatagcgattaaaataaagataagtaacgcactgtttgagaatagactgctaaagattgcttttacgtcatctaaacagtctgatttattgtgtgatttgttgtggcgacgaccttctttttcaggcaattgaactcgctcaaccgaaaatctccaacagatttggtacaaaataaacgcacagatcataaatgctcccataatgtatgtgaacatttctgggataattacttgtttaccttcaacttctttgtaaataatgagtggaataacaaatgagataaaaagtaccgcaatatttgcacccactgtacggaagatagataatccggcacgctcatcagcttttgtagtaatcacggaagccattgaaccataaggaatattgaccgcagtataggctaaactaccccaaactatgtaggtaacagtgatgtagaccaattttgcggtataagaccaatctttcacaatgtgtaagaaaagcagaaatcccgaaatacagataaagggagttgcccggcgaataagacctctgaaacgcccctctttaaaaggctttatagtatctactaaacgtcccataccaatatcagtaaaagcgtcaataaatctagaaactagaaatagaagaccgacaacataaccttcaatttgtagcacattagtataaaatagcattaaaaagaaggcggacatcataaaactaagatcattagcaatatcgccagccatataggcaagtttgtcttttaaaccaaaaggtctttgtgttgaactcataaaaactccttgtgaggaatatagattaaatatgggtatctttataaccgcagaacgcatcaactgggctaatacctttaaactcggaattacccattaatttttctaccagcaattctatggttggctctttgccgtcataagcattgatgtaagtttttacctgaggaacatcaactaaatggaatgggcattgaacggacacgaaaattgtaggtacttcatggacgtagaatggaatatcaggcgttcctttggtcgcttgccatacgatacgttgaactgtactcatttgcacattcgcaacattgataatcagatcataatgatccgttaatgttgtaattgggcgtttttgggagtattcattacgaatagttttgacctgttcttcgtccgacatcttgagaatattatccatcggtgatgtataaatagaaactgtaaatcctttttcttccagtttttcttttaagatttctgttgcactgcgttgactacctgcaaccattttaccgaagccaccatctgtacctttaacatttacaagtaagattctagggaaacgttcaacattaattgggaaaatatcttgtttatgtttaactaaggtaattgctttatctgcaacatcacggaaaattgctttatgttctggtagtcctatttttgctaatgcttgttcttttggttcaagcaatgtttctcttgggcgattgtgtaagcctaattttgcttttaaccctagaatacgagtaagggcatcatgaaggcgttcttcggtaataatgccgtttttataaccttccatcatataaccgaaatcttcatcaggatcgttaaagaaaaggaataaatcacaacctgcagcgatagcagtcggtagcatttcgctacgcttcattgctgaagtcattgctaccatatggctggcatcagtaacaacaacaccgttgaaacctaatttacctcgtaataagtctgttaaaattggttttgaaagtgtcgctggtaggcagtcctcataagctaaatttggattgaaatgctgctcgtaagcaggtaagtgtatatgacctgccatcaacgatggtaaaccagcatcaattaagccttgataaactttgccgaaagtattgtcccactcttcgcaactaaaactgtttacactaaaagaaagatgctgatctctttcatccactccatcaccagggaaatgttttgcagccggggcaataccactttcttgaatacctttcatataagccaaggacatttctagtactttctctggatttgaaccaaatactcgattagaaataattgggtttcgccagttataactaatatcaacgataggagcaaaactccagttacaaccgatagctgctgcttcaataccagctacacgccccatttcataagcatatttagcatcatcggttgcaccgattttgacttgtaaaccaatttctgttccatcactgcaagcaccattaccaccagcttctgtattcgctgcaattaagagagggattttacttttagtttgtagaatatagttttggtcataaacctcctcagcaggaccgggattataacgtaccgcaccaatatggtaacggtttaaaacatcagtgagatattcctcggatctgcttgaacccatattcacaaacagctgaccgattttttcttccaacgtcatattggctatagtgttttttacccattgaatatcttcatcttttaagtaataaggttttttcgttaaatcaacagacataatttctccttgcttatttgtcaaaatagtaataattgtgatcaagcggttaaatttgcattaaattttgcaaccaattgggcttgatattgagaatcaaatttttggtaaaccaatttccctaatgtttctaatactaactgatcccaagattcatcttcattgccacataaaatcgggaagaaatttacacttgcttcattggcactatttaaatcacccggtgaatcaccaaccattaaaatattgttcggttgatagccatattgtgctaattggtttaaacaatgagtttttgtaccctcatcttgtccataaactagatctacaaaagggagcaaaccatgtcttgtccattcatcaagaatagcttcattatttgcggaacttaccacagcgatgtctgcaaactctttaataatggcgagggaacgtttgactaaacggaacggtttatcttgagtatgtagagttttaatacccatattgactttttccgaccatgctaacgcaagttttagatcatcggtatggttgtcttgtattgcttgaataagtgaacgattggataattccgaagttgtatttacccagtgttttaattggctgaaatcctgttcataactatactcttccaaagaaagaatcaatcctttgaatcgattgataccacgtgtttgagagtaaaggttaattctattccaaatttcaataaaacgtgcttcatctgtaagtccaaaaatttcaacagcataaggtccgaaacacttatcatgtttaatattcattgtatccattgcacaaccgtcagaatcaatgcacacaataaatttatgttttggtataaatgttgtcattattttcccctatacaccgctgtaagcagagaaaccgccatcaatcggcaatactaccccatttatgaagctggcataattttcatccattaagaataaaattccacccatcaattcatgtgcttcaccaaaacgtcccattggagtattagttaaaattttattagctcgagctgtcggatttccttcactgtcaaaaagtaatcctctgttttggttactgactaaaaaacccggggcaatggcattacaacgaatacttactttagagaaataaacagcaagccattgggtaaagttactgatagccgcttttgctcctgaataggcaggaattttagttaacggagtataggcattcatgctggagacattaataatattagccccttttttgccgatcatatctttggcaaatacttgagtaggaagtaaagtacctaaatagttgaggttaaatacaaattcaataccatttttatctaaatcgaaaaatgattttgtactatctgctaagttaaattcatgaaattcattgtcggttgttgcttttgggctattaccaccggcaccattaatcaacacatcacaagttccaaagtctttttcgatagcatcacgagtttgttgaatactttccaaatcaagtacattggttttgtatgcttttgcaatgccaccattttgtacaatagcttgtgcatattgttctgccgattcgaggttaatatctaataaagcaacttttgcccctgtttttgctatttcttgtgcaaaaaatgcacatagcactccaccagcacctgtaataacaacgactttacctttgaaatcatgattgtttgcaatattcatatttttatctcctattaagattaattgatatgctaaatatacgtctatttttaaaactggtaaaccagttattaataaaagtgtgatttacatcacaaaatttaaacttttttggtttaccttttggttttttatgtaaaatatgcttaaattatagttgttttttggtgcgcgaaatgttaatttggtgaaccaaaaaagtattttacgaacaccatcaagaagtcaaaaaagcagagagacaaaaaaatgatggcaacatcacctgaagaactacgttcttataaaaaaatagggcaagaattaaaagcggaattattgagaggaacttatggtattggggataaattaccggcagagcgtgatttatctcagtacttcaatgtcagtcgtacagttattcgtgaagcacttatcatgcttgaacttgagaatttagtcgaagtgcggaaaggatctggtgtttatgtaataaatttacctaaatcgagttcagaggaaactgaagatttgcctgatgttggaccctttgaattgctacaggcaagacaattgttagaaagtagtattgcagaatttgcagctattcaagcaactcgagctgacgttttacacttaaaagagattttagatcgtgaacgtagaactttagagtgcggtgatgatgaagattatattgcagatgaggattttcacaaagcaattgcagaaataacgcaaaatgaagtggtgatccgcatgcaaaaggatttgtgggagtaccgaattaatagtcctatgtggaaaggtctgcatgcacatatctctgatcaaagttaccgctatttatggttaaaagatcacgaaaatattattgttgcaatacagcgaaaaaatcctgtattagcacgaaaaatgatgtggcagcatttggaaaatgtaaaacagaaactgtttgaattatcggatttagatgatcctaattttgatggttatctgtttaatgttagccctttggctgctgatttttaattagatgaggaatttactatggaacaaacatggcgttggtatggaccaaatgatccggtatctttggatgatgtaagacaggctggtgcaacgggagtggtgactgcgttgcatcatattcccaacgggcaagtatggtcagttgaggaaatcaataagcgtaaagcattgttggaggaaaaagggttggtttggtcagttgtggaaagtgtacctattcacgaagatatcaaaacccaaacaggtaactatcagcaatggattgataactataagcaaacattgcgtaatctagcgagttgtggcattgacatagtatgttataactttatgccggtattagattggactcgtaccgatcttgagtatgaaatgccggatggttcaaaagcgttacgttttgatcaagtggcttttgctgcctttgaactatatattttaaaacgtccgggagcagaggaaacttactcaccggaagagcaagcagaagccaaagcctattttgatcaaatgagcgaagcggatattgcgaaattaacaaaaaatattattgctgggttaccgggatctgaagagggttatactcttgaggaatttcaagcacaacttgatcgctataaaggtatttctacagagaaattccgcactcatttagcctatttcttgaatgaaattgtgcctgttgcacaagaagtgggaatccgtatggctattcacccggatgatcctcctcgtccaattctcggtttgccacgtattgtgtcaactatagacgacatgcaatggtttgtggatactcaaccgcttgccgctaatgggttcactttctgtactggttcatatggtgtgttagcagagaatgatttagtgaaaatggcggaaaaatttgctgatcgtatttactttgttcatttgcgatccactcagcgggaggaaaatccacgaagttttcacgaagctgatcaccttgccggtgatgtaaatatgtttggggtaacgaaagcattactcaccgaagaatatcgtcgcaaggcaaatggtgataatcgcttaattccaatgcgaccagatcacggtcatcaaatgcttgatgatttgaagaaaaaaactaacccgggttattctgcaattggtcgtttaagaggtttggcagaatttcgtggtttagaattggcattaaaaaaagtgtattttaatgactaattaaagaataaaggtactaagtgtcttagctgggaagtatagttctggacatggtgtgaaagaaacccgacaaattgtcgggtttttttcatctaaaagaacggtctgttttatactattttttgtttgacagaagaataaattacgccggttatcaaagacacgatgctacttacaacaagataaaaagaatctgttaatcattttaggttattagtatattattttacacaaagttttaaaatttgttcgctaccctgcacgagatattgatcatcttcagatcgtactcgattatttttcaaatctaacatggcatcataaataccttgtgtcagacttgcttgatcaagatgactccaacaagttgaacttaatctattaaagttggtttgtaatccgaaagcaaagagaataccgctataataagtatgcacatcgctgtctaatccattgcgttgaaacagtttttctttaatttgattgatcgggactgaaatttttgcggagtaccaatcttttacaccactgacaaaagcgttcacatgatattctttgttcacacgaccttggtaactttgtactgccaccgcataagcagtggcataagatttttgatctattttatcattgtccaagttaatcaccgtttttatattgttttccgatgaggtataagaagtaacagattttaccgagcaagctgaaatcagcccaatacataaaaataaagatattcttttaaacataaaattatccccaaagaaaaaataaattaattgtacagacggatcggatttaagccaataaagaaaattcaccgcactttctcatttattctcaacctttaaaacaaaatctaaaaatgctatattgtacgctgttttttctgactaacctcaattatttatggctaattatcaagatataacatttgcccttgcgggtgtgtgccaagcggcaaaattagtacagcaacttgcaatgaacggtacggttgaccaagaaattttgcgaactggtttaagtacattgttgcaaactgcaccggaagatactttagccgtttatggagggcagaaaagtaatttaaaattggggttggaaaccttaatggaacaattaaacggcagtgatgtaactttaaatcgctattggttaggacttttggctttagaaggtaaattacataaaaatgcacaagctaaatctgaactggctcgtcgtattcagtatttgcctacacaacttgcccattatgatttacttgatgaacaaatgctatcaactttagcttctatttatgttgatgttatcagtcctttaggtgctcgtattcaggtccaaggctccccgctttatttacagcaattaatgacacaaaatcgtattcgtgcttgcttgttgaccggtattcgttcggcggtactttggcgacaagttggcggtacgaaatggcaatttttgttttcacgtcgcaagctggtagcaacagcacaacaaatttattcatctatttaactgttcttaggagtaattcttttatgcaattcaacgcattgaccgcactttccccgatagatggtcgttatcaagacaaagtaactgctttacgtagcatttttagcgaattcggtttactgaaatttcgtgtaactgtcgaagttcgttggttacaaaaattatctgcaacaggcactattcaagaagtttcttctttatctaaagaggcaaacgattacttaaatcaattggtagaaaatttcagtttgcaagatgctgaacgcattaaagaaattgaacgtattacaaatcatgatgtaaaagcggttgaatatttcttaaaagaaaaaagtctggcaatacctgaattagtggcgattagtgagtttatccattttgcttgtacttcggaggatatcaacaatctttcttatgcgttaatgttaaaaaatgcacgtgatgaagtacttttacctgagtggcgtaagttaattgatgaaatcactcgccttgctacagagtataaagcaattccattattatcccgcactcatggacaacctgcctcacctaccacaataggtaaagaaatggcgaatgtggtatatcgcttacaacgccagtttaaacagttacaacacgtggaaattctaggcaaaattaatggtgcggtaggaaattataatgcccatttatctgcctatcctgagattgattggcatcaatttagccaagaatttgttacctcattaggtttaacttggaatccttatacaacccaaattgaacctcatgattacattgcggagttttttgataatgtagctcgttttaacactattattatcgattttgaccgtgatttatgggggtatattgccttaaatcatttcaaacaacgtactattgccggtgaaattggatcgtctaccatgccgcacaaagtgaatccgattgattttgaaaattcagaaggtaaccttggcttagcgaatgctgttatgtcgcatttaggtgcaaaattaccgatttcacgttggcaacgtgatttaaccgactcgacagttttacgcaatttaggtgtggggcttggttattgtttaattgcttatgcggcaacattaaaaggtatcagtaaacttgaggtaaatgaaccgcacttacgtgaagaattaaatcaaaattgggaagtgctggctgaaccaattcaaactgtgatgcgtcgttatggtattgaaaaaccttatgaaaagctaaaggagttgacgcgaggtaagcgtgttaatgcagaggcgatgcgtgagtttattgagaagttggaaattccagctcatgaaaaagctcgtttaaaacaacttacaccggaaacgtatatcggtagtgcaattagtttggtggaaaaattgtagattcggtgtgtttgtcttggctattgccccttagtataaaagcgtatcttagctacgtaaggggcaaatttaagacacttcagataagatttaattcaaaaatagacttttgccggttaagtttaaaaccttctcttattaataattccggttgttgcagattttgttccatgactaaaagtgtcgattgagtataactgacaaattcttttgcttttgcaataagtgcggtgtaaatttcactcttattttgggtatttttgacaaaaatatcatttaattgccaataacgttgcagttgtaatgaagaaaagcgaggatagagttgaataaagccgacagggttttgctgattatcgacggcgagaaagaagatactttcactaaatcgaattcggtttgataaaaaaataagagttcgctccggattttctatcatattatgggtgaggcggtattgttcaaacaaagacaataaagcgtccaaattccatagttcagctttaaatattttcatttctcaataattgttcaaaatttatgaaattcatacagtagattttatctttttagtacaaaataatcatcttttatgaaaaattttttatggatacaggaaaatttttgcaaaaaagagtatagtactgacagaatttttttattaattattatggagaacataaaatggctcgtcgtcctttagtcatgggtaactggaaattaaatggtagtaaagcctttacaaaagaacttattgctggtttaaaagatgaacttaatgcggtgtcaggctgtgatgtggcaattgcaccgcctgtcatgtatttagcggaagctgaaactgcactggtcagcagtgatattgctttaggtactcaaaatgttgatttaaacaaacaaggtgcatttaccggtgatatttcaacagaaatgttaaaagactttggtgtaaaatatgtcattatcggtcattctgagcgacgtcaatatcatcatgaaagtgatgaatttattgcgaaaaaatttggtgtgttaaaagatgcgggtttagttcctgtattatgtatcggtgaaagcgaagctgaaaatgaagcaggcaaaacggaagaggtttgtgcacgtcaaattgatgcggtgatgaatacactaggtgttgaagcatttaacggtgcagtaattgcttatgaaccgatttgggctatcggtacaggtaaatcggcgactccagctcaagcacaagcagtacatgcctttattcgaggtcatattgcaaaacaaagccaagccgttgccgaacgggtaattattcaatatggcggttccgtcaatgatgcaaatgcagcagaattgtttactcagcctgatattgatggtgcattagttggtggtgcatcgttaaaagcgtcagcgttcgctgtcattgttaaagcggcagcgaaagcaaaaaactgattttagttcattcataaaaagtgcggtaattgataccgcactttttagtattcatattagtattcataatttctcgttttcttaatgtctaaaatttatgtggtcttttttttatacctcaataatgtactgtattcagccatttgtcttggtgtataaccttatacgcagttttaagtcgccgaattatcgaaaacgtattttagaacgttacgctttttatccttcgctgactgaaccgaagccgaatggggttgtgattcatgcggcttctgtgggggaagtgattgcggcaactcctttagttaaaaagatacaacagcaatatccacatttatctataacgtttacaacggtgacaccaacgggatcagatcgtgtcaaagccgcttttggtcaatccgtcttccatgtttatttaccttatgatttacccgatgcaattttgcgttttattgattttgtaaaaccgaaaatgtgcattgtgattgaaacggaaatttggccgaatttaattaaacaattatatttacgagatattccttttgttattgctaatgcaagattgtctgaacgttcggcaaaacgctatggctgggttaaagcacaattacaaaatatgtttagtcagattagcctgattgcaccgcaagacgaggtaagcctgcggcgttatattgatttgggctacaatccgtcaaaattaaaattgacgggaaatatcaaatatgacttagtggtgagtgatgaattagagaaaaaaattaccgcacttcgccaatcttggagccaaaatcgcccagtttggattgctgcaagcacacatgaaggcgaggaaatgattattttgcaggctcatcaaaagttgctaaaaacttatccgcagttgttattaattttagtacctcgtcatcctgaacgttttaaccttgtcgcagagttaattgaaaagcaaaagcttagctatattcgccgttctgcacatgttaatcccgatttattaacacaggttgtacttggagataccatgggggagttgatgttaatgtacggtatttccgatattgcctttgtggggggaagtttagtcaagcatggggggcataatcctttagagcctctcgcttttaagttacctgtgattagcggtcaatatacttttaattttccggtggtttaccaaaacttatcagaggttcaaggggtagtgttagtcaatgaaaatagccaagagctggaaagtgcggtaaaaaatttgttatcttctcctcaattatgtgaacgctatggtaatgccggttatgaagtattggtccaaaatcgtggtgcattacaacgactatttgaattactacagccttatttggagaaagaataatgacaacggttatttatcctggcacttttgatcctattaccaatggacatatggatattattcagcgtagtgcggtcttatttagcaaagttattgttgctgtggcaaaaaacccgagtaaacaacctttatttaatttagctgagcgagttgaattagttcaattgtctgttgttcatttagacaatgtagaggtaatagggtttgatgatttattggcaaatgtggttaaagcaagacaaattgatgcgattattcgaggggtacgcacgacaatggattttgaatatgaatcacaacttgcacatttaaatcgtttgttgacgaatggtgtagaaagtttatttttacccccgaccgagcagtggtcttatgtttcttcaactattgtacgagatatttttttacatcaaggtgatgtgtcccgattagttcctgcagcggtattacgagctttagaaaagcgggctaaataatttgatgagattttattaaataatccttacattatgtatgcttaaaacactaaaactaaataggaaataatgaatgttgaataaaatttttgtgtggtttgaaagtcgtttaaatccttatccggaacagacgttcaatcacctacatcaaggtctgtttcgatttatttggtcaaatttggaaggaatgaaaaaatggattttcctacttgctttcttatcgttcggattgggggcaatggaggcaattcttttccaatttatgggcgttttggtggaatggctcagtcaatatgacgtgcaaactttatgggtagaaaaaggtgcttatttagttgggatgttgattttattgctatttagcattatatggtcttttttagcatcagctacacgtttgcaaaccttacagggtgtttttccaatgcgtttgcgttggaattttcatcgtttgatgttggggcaaagtttaagtttttatcaagatgaatttgccggtcgagtgtctgcaaaagtcatgcaaacagcgttggcattgcgtgatacagtgcttactttggcagacatgatggtttatattttggtctattttgttacctcaggtattgttttagcagcattagatatatggttattagttccttttgttctatggctaatagtttttgtggttattttatggattgttattcctgaactggctaaaaaagcagaacaacaagcggactcaagatcattaatgacaggtagaattactgatgcttatgccaatatttccactgttaagcttttttctcatggtgcaagagaggcagcttatgcaaagcgatccatgcaagattttatgatgactgttcatgcacaaatgcgtcttgctacttccttagatactctgacttatagcacaaatgtagcgttaaccttaagtacgggaattctagggattgtgttatggggaaaaggtttggtcggtgtaggagccattgctactgcgttggcaatggcactaagagtgaatggattatctcgttggattatgtgggaaatggcacgcttgtttgaaaatatcggtactgtaaatgatggcatggcaacactgacaaaaccgctaactattgtggataaaccggacgcacaagatttggagattaaacaaggaaatattcattttaacaatgtagactttgcttatacaccggataagcctttactaacaaattttaatttacatattaaagccggagagaaagtagggctgattggtcgttccggagcaggaaagtctacaattgtaaatttattactgcgattttatgaaactcagcaaggttctatcactattgacgggcagagtgtcgcagatgtttcacaagaaagtttacgtcgccaaattggtttggtcacacaagatacttctttattgcatcgttctgttcgggataatattgtttacggtcgtccggaagcgacagaagaagaaatgattgaagctgcaaagcgagcagaggcagcggagtttattccatttttgagtgattctcaagggagacaaggttatgatgctcatgtgggagagcgaggagtaaaactttccggggggcaacgtcagcgtattgctattgctcgagtgatgttaaaagatgcaccgattttgttactggatgaagcaaccagtgcgttagattctgaagtggaaatcgctattcagaatagtttggacaaaatgatggaaaataaaacagtgattgccattgctcatcgtttatctacaattgctgccatggatagattaattgtattagatcaaggacgaattgttgagcaaggcactcatactgaattgctggagaaaaacggtttgtatgcaaagctttggcaacatcagagcggtggatttttgagtgaatattagtcaagattttaggattaatcaaagacactaaaaaggcggaaatgtaagatttcaaattccgccttttgctcctcaaacagtgttatttaaatttgtcggcataagcagagctgttgatccactgatgatcttgttcccaagtaaatttccatttacgtacaggtcccgccataacattaaggtaatagttgttataaccggcaatagtggcaactgggtgataaccttttggtaccagcaccacatcgccatcatataccgccatacattcgtccaaagtgcggtcgtccgtatagacacgttgcagagcaaaaccttgtggtttatcaaaacgatgataataactttcttctaagtaagtttcatcaggactatctttttggtcatgcttgtggcttgggtaggaactggtatttccttcatcagtaaatacttcaaccactagcaaggcatctgccttttcggtttccggcaagatattgtgtacaaggcgtttgttattaccaaaaccacgtcgttctactcccacttgttcaggggtaattaaacgtacaggcaagtcaccgttacttggtgctcgacaaacagccaactctaaataagtttcagctttaatttctatttgttgatggtgtggagcgtacaccgaataaggcggaattttctcaaacggtgtagttcgattaccaatattattatatgtttcaccgccagctgagacagtggctttaccacttactaaaacaaaacaagtctcagtagtttctgtattaaaacttaatgtctgccctgcttgcaaatgatacatttcaaaaccgacatattcccaaccggcactttctggtgtgattttttgtacttcaccatttgcagcaggattgtctttgcgtgatttagataataagtaactcatattttccccaaagtgatcatattgataaaattttgccgaaatcataccgcactgcgtaaatttcgctatgagaaatatagaaaaatcagagatagatcacaaaataattattttacttatattagaatttgataaaaatgttttatttatgattttttttgcagtatataaactaggcgttttataagatttagtagtatagaaatctttgttaattaaaaataaaggagttttgtatgaaaagctttttgcaaaaatatgggtttaccccagcctcattttttcaactcattctgatcactgttaatgcacaattgatttatgctttttgggatattcgtaatagcgtacctggtggttttcctgccgctttaggggtaacggatcaacaagccggttatttatattctatgcaaggacttgtaattattttagggactattgctttaggttgggttggtgaccgtttttcaattcgttctattatgttgctatctacggttggtgtgggtggaatttctttatttctaaccctctcatctccgggacttagcatgcctgtgttactggcttgtttcttctctatgttattttttagtgaggtattatttaaaccggctaatttcaaagcattaagaatttcaaccacggaaaaacatcaaggtatggtatttggattatttgagtttggtcgtgggttgcttgctttccttatctccttgttatggacggtgatgctttattataaagtcggcccgaaggcaatgatgatgacaagttgtattattgttattattactggtattgcagtgttttttattgtacctaaagatcaaaaagtcggagatgaagatactcaagttaatacgaccaaagaagctattcagggtgttgctcgtgtagctaaattaccggttgtttggattgccggaattaatgtgttctgtatttatggtgcgtttgttgccgctgggacctattttgcccgttttttacaaggtggatatggtacaagtgcggttgctgcggcagtttttgcaacagtagttattgcattgagaatgttacctttggtttcttccgttttagtagaaaaagtctttgcttctaccgcacacttcatgcgaatgatgcaaattattttagtggttattctttctgtaattggaattatcttttttaccaatcatccagatatttctttatatgctgatggttatattccagataataccccggtaggactcatttcttccagtatgttctggacactggtagttcttatgttatgtgcatcagcttgtatcttcatgattcgaggtgtttattatgccccaatcggtgagatgggggttgataaaaagcattcctcagcagcaatgtctttcgccattactattggctattttcctgctttattagcaccaattgtattaggcggcttggttaaatcaccggcaaaagatgctacaggacaaattatccgctcttatttaactgatacgcaagtgttagcttgtgctttctttgggcttgcgattcttgcgttaatttctgtttttatgtcacatactttaattaaaatgaaacagaaacagcaatcaaaaactagtaatcaataggcggttttttatgaatggtcaaaaaataataggaagtcagtgtattaggcaatgtaatcccgatcttcgcattaccgaattgattattccaggaactcatgactctgccacatcaacgtgttatgaacgttattatcgaacacaggatttatcaatagcggagcaattggattgcggtgttagatttttagacattcgtttacgcaaagaaatggttgcagcccatcgagaatgggttagtgatattcgagcagaggaaatttttgaaaagtgcggtgagtttttacaaaaaaatccacaggaattcgttttaatgcgtattcaaaatgcaaatgaacggaaagatgattttcctgaatatggcgaagcgttgttgtcaaaagtacagcaatataaatctttgttttatgcttgggagcattctcaaattgttcaagatggcaatccaaaatggccaactattgcacaagcggctggaaaaattgttccgatcgaatgtgctccgccaagtatgtcaattaacaaaataaacggtgaattatgggcagccaattggcatgataattcgcagattttgttacaagacttgtgggatggtccgacagtagaagaaaaatgtgtggcaattaaaacgctgattgaaaaaggcagagaggtacactcggacatactgttgttaaatcatattagtgcgactaatggtgaattgcagtatccggatgcttatgcagcatatttgaatgaatactctagtcgattatggaaacaattggcgaaacgtagttttagaggtgtgcagatttatgattttattaatccttctatctgccaagaattgttgcgattaaattttgattagttgagttgatagatttagcaaaaatcaaatctagatcacaaaaatgaaataaatatttcgttttcaataaaatgaattgaaaattttattccattgatctactctaaagacgtagcaagaaatgctttgtgattgagcaaaaatacttaaggagaaaataatggaaacggttttgaactttatcaatggtaaacaagtagcaagtaaaggtactaaagcttggcctatttataatccagccacgggtgagcaaattcgccaagtaatgatgagtactgcagaagaggtaaatgaagcggttgaagttgcacaaaaggcatttcctgcttgggctgcgacttcgccacttcgtcgtgcccgtgtaatgtttaaatttaagcaattgttagaacgtgattgggatgacttagctcgtttaattaccgaagaacatggtaaagttttctctgatgcacaaggtgaactaactcgtggtttagaagttgtggagtttgcttgtggcattccacatttagtaaaaggtgaattttctgaacaagccggtcgtgggattgatattcattcagccatgcaacctttaggagtttgtgtaggtatcacaccatttaattttcctgcgatggttccaatgtggatgtttccgattgcacttgcttgcggtaatacatttatcttaaaaccggcgaaagccgatccatctttatctattcgtttggctgaattattaaaagaggcggggttaccggatggtgtgtttaatgtagtgcatggtgatcgtcaagacaatgaaattttattgcgtgatcctcgagtgaaagctgtaagctttgtgggttcaactacggctgcggcacatgttcatgcgattggttcggcacatggtaaacgtgttcaagcactgggtgcggcgaaaaatcacggtttagtgatgcctgatgtagatattgaagcaacagctaacgcactattaggtgcggcattcggtgcagccggtgaacgctgtatggcattacctttagcagtaaccattgatgatgaaacggcagataaattagtcgcagcattaaaaccgaaagtagaggcattacgttatggtcccggtctcactaaagaaggcgaaaaagaaaatgattttggtccattaattactcgtcaacatcgtgataacgtaaaacgttatgtagatataggtgtgtcagagggggcaactttagtggttgatggacgtgataaattccctgctggttacgagaatggtttctttattggagggtgtttatttgaccatgtaactcctgatatgactatttacaaagaagaaatttttggtccagtattaggcattgtccgtgcgaaaaatttccaagaggctatgaaactaattaatgagcatcaattcggtaatggtgcagcaatctttaccaataatggtgcggcagctcgtgaatttgcatatcaagtacaagcaggtatggtgggcgtgaatgtgccaattccggtgccgatggcattccattgtttcgggggatggaaagaatccgcttacggtgcattaaatgcttacggtccagacggtgttcgtttttataccaaaatgaaaactgtaacaacacgttggccagagaaagatctttcatcacaagcagcattcagtatgccaaccctataaactagacaacagaataaaaatttaagttaatgtaaagaagatagttttttagctatcttcttttgcaagaaaaggaaatgaaaatgaaaaaagtccgagtcggtttaatcggaacaggttatattggtcgttgtcatgcgattgcttatgcacaagcaccgacagtttttcctcttgaggctgaattggttttggaatatttagctgaaatcacaccagaactggcacaacaaaaagcacaagaatttggttttaatcgttcgacaggtgactggcgagatgtagtatccgatccaaatatagatgttgttgatatttgtacacccaatttcttgcacaaagaaattgctttagccgctattgctaatggtaaacatgtttattctgaaaaacccttagcattaaccgcagttgatgcaaaaatcatgtatgaggcggcaaaaaaagcaggtgtcagaacccttgtgggatttaattatattaaaaatccgactacacaacttgctcgtgaaattattgagcgtggtgaaattggtgaagtaatccatttctatggtacgcataatgaagactatttagcatcagatacgacacccttagactggcattgtgttcgtgaaaaagcaggacttggtgcattaggtgatttggcagcacacattgtgcaaatgtcacaatatttagtaggtagcgatattgaaaaagtgatcggtgatatggagacggtagttaaagaacgcccaaatccccaaaatcttgcagagcgtttaccggtagaaaacgaagatcaagcaactgctatggtgcgttttgcaaacggttgtatgggaaccattgaaacgtctcgtattgcttgtggacgtaaaatgggattgacttatgtaattaccggaacaaaaggtacaattacctacacacaagaacgtatggcagagttaaaactctatcttcacgatgaagatcctgctcgtcaaggctttaaaacaattttgacaggtccgttacacgcagattataaaaatttctgtgtaagtgcgggtcatggtattggttttaatgatcaaaaaacggttgaaattcgtgatttagtgaatggaatagcgaataatcataatatgtatcctgactttgaagaaggttttaaagtttctcgtgtattagatgctattgcacaatcttgccaagaaagacgttgggttaacgtgaaagaaattgcgtaattttcaccgcacttttataagtatttaaaaaggtcgagttgaatgactcggcattttttaggtataaatttaaaatgttgtttatctctaatttttaaaaatttttccctcaaaaagtagatcttgttcacaaaattttaacttcatcattgctctgtatcttgataaatgttacatactgttttaaacaatttatttcaaattgttttatttttggaatttatatttcttcaagtggaatatagctgtatttcagaatagtgattaactcaactttccaggagtagcgttcttatgaagaaaacattattggctatgttatgtggcggtctattattaacctctcaagctgtaatcgcaaaaaattatgtcattggtgcacctatgaactcttttgcggataaatggcaaacttatcttcaagatgccgttcgtgattttgatgaaaaacatgatgatgtgcaaatcaaattggctgattcaaatagcgatcccaatattcaagtcaatttagttcagaattttatcgaccaaaatgttgatgcgttacttgtggttccaacggatccgacagtagtaaaacgtattggcgtgttagcaaaaaaagcgggcattcctttaatcgtggtgaaccgtaaaccaaatgatgagcatatgcaatatgtaaccagctttgttggttctgatgaaattgaaggggggcgaattcaaggtaattttattgtcaatactctagccggtaaaaatgcagagagtctcattttactcggaccattggggcaagatgcagtcactaaacgtactcaaggtaatgaggaaatttttgctcagcacaagaatattaaagtagtgagcaagcaagaaggtagatgggaacgtgaccgtggtttagctattgcagaaaacgtattggcggggaataaaggtattaacgttattgtgagtaacaatgatgaaatggctattggtgcaattcttgcaactcgtaagttaggtatcaaagacgaagacattactatcgttggtttagatgcaactcccgatgcgttagagtatttaggtaaaggtttggatgcgacagtattccaatccgcacaaggtcaaggttacaccggagctgaaatggcttatttagcggctaaaggtgaaaaagtaccaagcgttaaatgggttccttttgagctagttactccggataaaaaagaagaatatcaagcaagatataaatagacgcttcttaaccaacacaaagggtagtgtaatacctaccctttatcttgagcaaatgttgatcgttatcatctagagacaaagttatgttcaaaaaatcattgtttattttattgggagtagcgtcgttgttttcccccattgttacggcaaaaaatttaaccgttggcgtggcgatgtatagtctttcagataaatatcctacctatttgcaagatgctatgaagaaatttgatcaggaaaaagctgatgttacttttcgttatgctgatgcaaattcagatccggcaagaatgttaagcgatattgaaacatttattgattctggtgtagatgctttgttagttatgccgacagatagcgatattattaaagctattggtgttaaggcaaaaaaggcaaaaattccgttagttgtggtgacaaataagcctaaagatgaggatatgaaatatatcaccagttacgtagggtcagaagagattactggtggtgaaatgcaggcaaactttattgtagaacaattaaaaggtaagccggcaaatgcgattattttaatgggacctctaggttgggatgctcaaattaaacgcactgaaggaaatgaaaatattctgagaaaacaccctgaaattcaggtgatcagtaaacaggaaggtaaatgggatagagcaaaagcaattgatattacagaaaatttgttatcaggtagtcaaaaaattgatgtagtgatcagtaataatgacgagatggcaatcggtgcactccttgccgcccgtaaaaaagggattgcagacgaggatatgttgattgttggattagatgcaacacctgatgcgttagagtatttaggtaaaggtttggatgcgacaatttatcaatctgcttccggtcaagggcgtaccagtgcagaaatagcgtataaagcggcaaaaggtgaaagtgtacctaagttgaactttattccttttgaattggttacaccggataaaaaagcacaatatattgataaatatagatgatagaaaacagtaaaaattaaccgctctttgttgttagaaattaccgttattaatacgacaataaaaataaggagttctaaatgaatgatttgagtcgttctccatatattttagagatgcggaatgtatctaaaacattccccggcgttaaagcattggacggcattaacttaaaagtcaagcgtggaaccattcatgccttaatgggggaaaacggtgcaggtaaatcaacgttaatgaaaattctctacggcatctatacgccggatgccggtggagaattaattttagatgataagccttttaaaccgagtgcaccgattgatgctattcgcactgggttgactatggtaccacaagaaatttctcctgcgggtaatttaactatcgcagataatttctatcttgggcgagaaattactcgtggtaaattctttttaaatcaaaaagaaatggattgtaaaacagcggaaatcttaaatgaattgggtattccgatggatgtaaccgctaaaatgtcagatgtttccgtagcgaaggcacaattggttgcgattgctaccgcagtttctaatgatgcgaaagtaattattatggacgaaccgacaacggcattaacagaagtagaggttgaacagctttataaaattattgaaacggtaagacaaagagggatttcaattatctttatttcacataaattagatgaagttttccgtgtttctgatgaaatcacagtaattcgtgatggtcaatatgtaggtacgaaactaacctcagaagtaaccaaagatgaattgatttctatgatggttggtcgtgatatgtcagaaatgttccaacgtgaacgtattgtcatttctgatgaagttgtactcgaaattaaaaatttctctcgtgcaggcaaatatcatgatattaatttccaagtgcgtagaggagaaatctttggtattgccggtctagttggtgcaggtcgttctgagattgtagagggattgtttggttataaactggctgatagtggtgaaatctatgttcatggcgaaaaagccgatattaaaaccccgttagatgctatgaaatacaaaattggctttgtaacggaagatcgtaagttaacaggactgtttttaaatttaagtattactgacaatatgattatgcctagaatgtccccttacttggaaaattttttagtgtcggtgacaaaagcacagaagtcagcaaatgctcaaaaagataaattaaaaattaaagcaccaaatgttgaggtcattaccaataatttatctgggggtaatcagcaaaaagttttattggctcgttggttattacttgagccggatattttaattttagatgaaccaacaaaaggtattgatgttggggcaaaagctgagctttataaactcatggtggaattagcaaaacaaggtaagagtattatcatgattacatcagatatgcttgaattgctttcgatgagtgacagagtgatggtaatgcacgaaggtcgtgtagccggaattattccacaagaagaattgactcaagaacgggtgcttgaattagcatccggtttaggtcaagtataaaaagatttcccctagaataacaatcgaggtatttattatgtcaaatgctacgcttaaaaaaatattgaacgcctatggaatggtgtttattttaattgccttatttttagcattatctgcatcaattgatggtttcttttccgctcgtactgtttggagtattattgagcaagtttctatgtttgggatcattgcaattggagtaacctttgctattatcacaacggggattgatttgtcctctggttcaatggtagcgatgacttctgttgtggctgcttctatcgtaactggtggcgatacagtaagttcggcattacttgcttttgcgatttcaattgtattaggtgctgcaatgggggctatcaatggtagtttaaccgcttttggctctatccctccgtttattgctactttaggtatgatgattattgcccgtggtggtgctcaactttattcttcaggtcgtccaattgatgcctcttctgaagcatttacttggatttctgatgttgatttctttggattacccggtttagtacttgtttatatcgtaattgtcattgcttcacacattttactgagccgttcaacatttggccgtcacgtttatgcagttggtggtaatttaaacgcagcaaaaatttgtggtattaatacaactaaaacattgatttgggtttatgttttcgccggtgctttgtctggattagtgggggcattactggcagctcgtacttatgcaggtaacccctcttatggtttatcttgggagcttgatgcaattgccgcagcagtgatcggtggggtatcgctaagtggcggtattggtacaatccctatgtgcgttatcggtgctttaattattgggacaacaaacaaaggattaaatatgctgggagttgatccatattggcaacaaattattaaaggtttgattattgttgttgcggtattaatcgatacattaaaacgccgtagaaaagcaaattaagcaaaaggttacaagaaaaaaatagcaattgtatagttgctattttttttgtttgttggggaagtgcggttagaaaaatttgatcagctccacaaaaatgaaatttatttttcatttttattttatttgaaacgaaaatatgattatatagctacaaatttcaattatctgatttgggagatgatgatgaagacagtgagattaacggtagctcaagcattagtaaaatttcttgataaccaatatattgagttcgatggaaaggtaacaaaattcgttgaaggcattttcgggatttttggacatggtaacgtgctgggtttaggtcaagcactggaacaggatagtggcgaattgattgtgcgtcaaggacgtaacgagcaaggcatggctcatgtagcaatagggtttgcgaagcaaaaattacgcaaacaaatctatgcctgtacttcatctgttggtccgggggctgcaaatatgattacagcagctgcaacagcaacggcaaatcgtattccacttcttttattacctggtgatgtttttgctactcgtcaaccagaccctgtgttgcaacaaattgaacaaacttatgatttaagtattagtaccaatgatgcttttcgtgcggtaagtaaatactgggatcgtgtaagtcgtcctgaacaattaatgacagcttgtatcaacgcaatgcgtgtattgactgatcctgcagaaaccggtgcggtgacaattgcattgccacaagatgttcagactgaagcttatgattttcctgagtattttttacaaaaacgtattcatcgcattgagcgtacacctccaacggaagcgatgctacaagatgctttgaccttaattcaaaatgcgaaaaaaccactaattatttgtggtggtggagtgcggtactctgaggcggcagagcaattaaaagcctttgctgaaatttataatattccatttgcagagactcaagcgggtaaaagtgcggtagtttctgagcattatttgaatgttggcggtataggtgtaacaggttgtgtagctgcaaatttattagcaccggaggctgacttagtcattggtattggtacaagatatactgattttacgacgggatctaaatggattttcaataatgacgaagtgaaattcttaaatatcaatgttgctcgctttgatgcttataagttagatggtgtacaagttacagctgatgccaaagaaacgctggaaaaattaaccgcacttttagctacaacaggttatcaagcccaatggggtgataaagtggcacaggcaaaaaaagcgttggaaactgaattagagcgtgttcacaatataacttataccgaagattttgtacctgaaattgatgatcgtttaaatcgtgaggcggtttatgctgaatttatggagatgaccaaatcttgtttagctcaaacaagggtgttaggtattttaaatgaaacattaggtgaaaatgatgtcatcgtgggggctgcgggtagtttaccaggcgatttacaacgtatttggcagtctaaaggcgaaaatacctatcatttggaatacggttattcttgtatggggtatgaagttagtgctgctctaggggtcaaaattgcagaacctcatcgtgaagtttataccttcttaggtgatggatcttacatgatgttgcattctgaactggtaacgtcaattcaagaaaatagaaaaattaacgtaatattattcgataatatgacaaacggttgtatcaataacttacaaattggccatggtatggacagttttgcaacggaatttcgtttcagaaacaagaataccaataaattagatgggggctttgtaccggttaattttgctatgaatgccgcatcttacggttgcaaaacctatcaagtaactaccgaagaagagctacgattggctttggctgatgcaaaaaaacaacaggtttctactttaattgatattaaggttttaccaaaaacgatggcgaagggatatgaaagctggtggcacgttggtgtggctgaggtgtcaaataaagctgaaattaatgctgcctatgaagattctattgctcatattgaggtagcaagacgttactaatttaacttgataggctcaatattgagcccatttatcatgaaattcattcattctttttaagaaggacaacagtatgaaagctgaaaatgtaaaattgggcattgcaccgattggttggacaaatgacgatttaccggaaattggtaaagagaatacttttgaacagtgcgtaagtgaaatggcattagctgggttcaccggtagcgaagtgggaagtaaatatccacgtgatattgacgttttgaaacgtaaactggatttacggggtatccaaatttgtaacgcatggttcagtacattctttgttgatggtaaaaaagaagaaactatcaaaggttttatagagcatcgtgattttttacatgctatgggagctaaggttattggttgctctgagcaaagtcgtagtattcaaggtcagaaaaaagcaattttcaaagagaaaactattttcacggaagctgaatggcaattgctagcggaaggttataatgagcttgcaaaattagccgcagaaaaaggcatgaaggtatgcttacatcaccatatgggaactggtattcaaacacccgcagaaattgataaatacatggaaatcactaatgatgatgtgtatttattattcgattcaggtcacctttattattcagaaggctcacaacaagttatgctggaggtattagaaaaatatattcaccgtgttgttcatgttcacctaaaagatgtgcgtgatgaggttgtggcggaagtaaaagcaaatgatcttagtttcttggaaggggttgttaaaggtacattcactgtgccgggagatggtgtaattgatttcaaaccgatttttgatattttagaaaaatatgattataaaggttggatggttgttgaagccgaacaagatccggcaattgcaaatccgttagaatatgcaattaaaggtcgtcaatatatcagagaagttgcaggagtttaaaatgattaaagtaggtattattggtgcaggtcgtattggtcgtgtacactcagaaagtattacaaaatatgtaaaaggtgctgaaatcaaagcgatttctgatgttcgtgttactgaagagttaaaagaatgggcaaagggaatgggtattccgaatgtctatgaagactataaattaattttacaagatgcggagattgatgctgttttagtctgttcttccactaatacgcatgcaccgatttctattgaagcggctcgtgcaggtaaacatattttctgtgaaaaaccaattgacgcagatgttgatcgtattcagcaagtattagcagaagtggaaaaagcgggtgttaaattccaagtcggttttaaccgccgttttgaccataatttcaaagcaattaagaatgcggtagtcaatggtgatattggtgaaccccacgttattcgggtcacttctcgtgatccagatgcaccgccaattgaatatgtaaaagtgtccggcggtatgttatttgatatgacaatccatgattttgatatggtgcgttatttgtccggcagtgaagtaacggaggtatatgcggcaggaggtgttcttgttgatccgaaaattggtgaagcgggcgatattgataccgcagttattaccttaaaacttgcaaacggggcaattgcagtgattgataatagccgtaaagcagtttatggttatgaccaacgtgcagaagtattcggttctaaaggtgcgatccaaaccgcaaatgatacgccgtcaacagcaattttatctaatgtgaatggtgtcatcgcagaaaaaccaaaatatttcttcttagaacgttacatgcaatcttttgctgatgaaatggcgtgctttgttgactcagtggtgaatgacaaaccaacattagtaaacggtactgacggtttgcaaccggtattaatcgcaattgcagcgaaaaaatcattggatgaggggcgtcctgttaaaatgagtgaaatttcctagtttaaggagattgcaagaaaaagggcggtaaaattaccgctcttttggtttgtacttctgttacgttgccaaatctccgaaacagacctgtaatgcggtgattgcactaagtgcggcagtttctgtgcgtagaacacgcttaccaagtaaaatttcagtaaatccctgagtttctgtttgactaatttcttgtgcagaaagtcctccttctgaacctattaacaagcgaacaccttgcgggggaatttccggtaaggtacgaattgtatatttagctcttgggtgaagattaagctttaaggttccgtcttgttcagcacaccaatcttgcaatttcattaatgggcgaatgtcaggcactatattacgcccacattgttcacaagcggaaatcgcaattttttgccattgttggatttttttctccatacgatccttatcaagttttactccacaacgttcagaccataatggcgtaattatgttgacccctaactcaacggatttttgaatagtaaactccattctttctccacgagaaatcacttgacctagatgaataaataatggactttcacgattttccaattgacgagagagaatgttaacttcaattgcttttttatttgtttgagtaataatggcagggtaaatatggttacttccgtcaaataattcaatttgctcacctacctgcatgcgtagaacacgccctacatgatttgccgcatcatcgcttaattgacaagtttgttgattttctaaagaggttggatgataaattcgaggaatacgcatattatttaatgggttagttaattttgttgctatgataacagaaattaaaagtgcggtgaaatttaccgcactttttgtcattgtatttgttgacttgaaaaaataaataattttaccttatttttttatatcaaatttataagaaataaatccatatagcgtccaaccgatgaatgttacgattgatccgtatagcatagcttgctcacctgctgcgtataaggcatataaactatataacgaaccgatgaaggcaacaaatgtggtaattttagctttatttaatgctactttttctactttaagtaagaccattaatgcagccattgataacagataaggtattacgttggtcaccaccgccaagtctactaagatgttaaattgtttgtttaaagatggactgatcgtcatcagtgctaataaactttgaattgcagtaattgtaaccataccaataataggtgcgtttttactggtcacttttttgaagaatgctgggaaatatccttcttcggctgaagatttgaatacttgagcaatggtaaactgccagcctaataatgaaccgaagcaggacattaccattaagcccattaccactttacctgttgtttcttcaaacatatgtgcaaaagctaaaccgaacggtgctgttgaattagcaagttccaaattaggaacaataccggcaattacgttggtggaaacaatataaataaccgccgcacctaatgttccgccaagaactgcgataggaacatttctttcaggattttctactacatcagtattcgcacaagctgactctaaacctaagaaggcccataacgtcatagaaatagatacgccgatggcttcaaaagtgggaacgttatgtgggttccaagcactgacatacatttcaccactaaaccagaaccaaccaattaaacaaatccctacgaccggaataattactccccagatagtaaaagagctgatgttaccagtgattcttgctccaccaaaattcaaaacagttgctaaccatagtgtgaatatagtgcatagtgcaatggatatcggtgataaagtgacatttaatagctctgatccgtatccaacggcggatattgcaatcgcagtattggcaatgactagagaaactccataagtgtagtttgccataaagttaccggctttaccgaaagaatattccgcataaccacccataccgcctgattttttactgaacataccacattgagcaaaagcataggctaaagcagttgaaccaacagctgtgactaaccaagatacaattgagatagttccaatttcagctaattttgtcggtagcatgataatgcctgaacccatcatatttaccattgtcagtatagtgagttgtactacaccgattttattacttttttgagtactcataattttatccctctattaaagtgcggttatttgtaattaaccgcacttatttttttattatgcttcagttaatacatatccataagcacgtgtacgtccatcaggatctttttgtagatatacgccctgaatttccggtgcgaatccaggaagaacattaatgccttcttccagtgcaaggaaatattgttgtactgtcgtactccaacgttcaccgggaacaacacataaaacacctggagggtaaggtaatgcaccttcggcggcgattctccccacaatatctgtcaatggaactaattcaattttgttacgaacaaattcgatattcgctttttgtgggttcatagcatattccggtagagttgtttttctaaacaagtcacgttgtagctgtttaacatttctactgacgtaaagattgtgcatttcttgacataattgtctgatagtgtagccctgatagcgttcctcattatttttgtacacagtaggcagtacatctttgagtaatgaattttgtttgatatgtttttcaaacgcagctatttgagcaactaaagtttgcatttttgtcaatgtttcagctggtgtaagcaagaataaaatggagttcaagtcacatttttcaggaatgattccattttctcgcaagaagttagcaaggattgttgctggaataccaaagtcttcatattcccctgtttcaatgttaatccccggagttgtgagcatgaatttacaagggtcaacaaaatattgattatctgtataaccctcaaatttatgccatgtatcatttgcatggaaattgaaaaactcaagatcatttgcaatttctttagtatcgtgatcttgccattttttacctttcacataaggaggaataaatggtttgattaaagtgcagtgcttaagcattaactttcttgcctcgataccaacttctacacactcggcccatagacgtttccctgcaggagaaccttgaatttgagcgtttacatccagagtggcgaatagaggatagaatgggctggtagacgcatgcaacataaaggcattattaaagcgtttgtgattgcaatatcttgcttgtcctttaatatgtttgtcttttttatgaatttgtgatgtttgtgagaaacctgcttgttgtttatgtaccgattgtgtcacgataataccagggtcattttcatttaaatctagtaataatggagagcaatctttcatcattggaatgaattgttcatagccgacccatgcagaatcgaacaagatgtaatcgcataaatgtccaatacgttcaacaacttgtttggcgttataaattgttccgtcataagtacccaattgaataattgcaagacggaaaggacgtttctcttcaagtttttccggtgtcacttctgcgattaattttttaagatatgcttcttcaaaacagtggttatcaataccgccgatgaagccgaatggattacgggcagtttccaagtaaacaggggttgcacccgcttgaattaaagcaccgtggtgatttgatttgtgattgttgcggtcaaataatactagatcacccggtgcaagtagtgcgttacaaaccactttattggaggcggaagttccgtttagcacaaaatatgttttatctgcattatatacttttgctgcatgttgttgagcatcacatggagcaccctcatgtattagtaaatctcccaatttcacatcagcattacaaatatctgaacggaaaatattttctccatagaaatcgtatagataacggccggctggatgtttgcggaaatattgaccgccttggtgtcccggacaatcaaatgccaaattacccatttcgacatattcgcttaacattttaaagaatggaggtaacattttttgctcataaagagacgcagctgtttcaatttgacggctatacaaattgatatcatagctgtttagatcttgaacatgataaacctgatcaaaatattcatcagaaagtgtttcaccttcatttaatacgacaaaaataggaatattaaattcagtcgtttttatttgttgaatatacttaacatcttcggcagtcaatattattgcacctatatcggtgaaatcagtttgatttaataaaactaattcacgagttgatgtaaaatatttttgcactaatgggctatgtgcgatttttaattttaacataaaagactcctttgtcttatttaaagaatacaaatcaccctctcacaataaatatagaaatagtgagatagcttacttttaaagttttataaattattaatataaacagtacgtgaatttttatatttatttaactataaaaaacacgaacacttattctagaattaagaacaaacacaggtttttatttatcaagaaaaaccgtataaagaatataaaaattctaggacaaaatattaataaagtagaaaaccgtgaaatcccctttatttaaagggaattaaatggaaaagaattgatatggattacttttagaatggagaatagcaaaagaaaaacaagaacgatgggacggtttcataaggtgtcgagtacgacgaatatgtgccatcaaagagcgacccttaatagggttatattcttgactataattgtggtctaacataatagcctccgaaatttattttgcttatatagttttagttgactatcgaagcaaattttgcgcctataaaataaaaagtcaataaattttattttttttttttttttttttttttttttgacggagatcacaaaaattaaattttgttactattttatgatatgacttattttccttttttgatccaatatttaaatggagtgttttctaaatcactttttaataaattatgatccataaattgacaaaagctaggaatatctctagttgtggcaggatcatctgcaagaattaataatatttctccttcttgcatatggcgaatttttttgcgtaagagcattattggttccggacaacgtaatccaattgtgtttagagtttgtgttacaataatatcagtcataataatttctttgttagaatagaaagcgtgtatgatagcgtccaatttctttagggtcaaaataagcaaagtatgaaatatcttattccccaaagtgcggttgtttttgaagaagaaattaagaagagccgttttattacttatcttcagcatgcagaaggtttggagcaggctaaagcattttggcattcaataaaaaatcaacatccaaatgctcgtcatcattgttgggcaacggtttcgttacaacccggtaattcgcaaggattagggttttctgacgatggtgaacctagcggtacggcaggaaaacctatgttgaatgctttattggggagtggtattggtgaaatttctgctgtagttgttcgttactatgggggaattttgctcggtacagggggattagtgcgagcttatggaaatggtgtgcaacaagctttgcaattgttacagacaagtttaaaaatagaacgaaaaatttatcaactttattgtgcgtatcatcaggtcaattggttacatgttttatttgaaaaatataatattaggatcatttctcaacattttttacaggatgttcaatttgagttgggtataagtgatgataaactggcagcatttcagaatgacttatctagttattcagcaggacagttaagattattagaaaacaaataagagagaaaattgtgcatattttatctattctgcgtatagtgggaattctagtaacttgcttttccattacaatgttaattccggcttttatagcgttgatttatggagatgggggtggaaaggcttttatcttgtcgtttttttacaatctttcagccggagttgggttatggtggctatgtcgagcacataaggcaagtttacgttcacgtgaaggatttttaatcgtcacaatgttttgggttttgctcagtttattggcagttattccttttatgttgttcgatgagctaacattgagccttgccgatgctgtatttgagtctttttcagccttaactacaacaggggctacagtaattttggggttggatcatttgccaaaatccatccttttttatcgtcaacttttgcaatggattggcggaatgggattgattgtattagtggttgcgattattccattgcttggtattggtagtggtcatttatatcgagcggaatcttcggggccaatgaaagatcaaaaagccttgcctcgtattggtgaagtggcaaaattattatggtttctctattgtatattgactattttctgtgcgtttgcttattgggctgcgggaatgagttggtttgatgcgatttctcatagtttttctacggtgtcaaatggcggaatgtccaattacgacgccagtttaggttactttgacaatccggctatttatttgattagtgctggttttatgctgattagtggttgtaattttgctttgcatattcgagcattaactaattggaaataccaacctgtctggaaaatttacgcaagagatcctgaatttaggtttttctgtgcaattcaagggatatttattttcttattatcgttagggttatatctgacctatgaaaattattctgtttttgatgctttctcacaaggtgcgttgcagtcagtatcaatggcaatgacttcaggttatactttatttgatttaaatcagcttccggcttttttggggatgttactggtctttatggcaatattaggaggatgtgcgggatctactacaggtggtttaaaaatgattagagtgcttgttgtatggttacaaatcaaaagagaatttaaacatttagttcaccctcatttggttattccaattaaattggggaaaatgttattggcacagagagttattgatgggatatggggatttttaattgcatttttcttaacctattgggtatgtgtatttgcggttatattatgtggaatgaatgctgctgatgcgatgttgtctgtctttgccacactaacaaatgttggaccaggtttgggaataattagccaaagtttttcacaagttccggataatgctaaatatgtattttcttttgctatggcagctggtcgtttagaaattttttctcttttacttttgtttacgccgactttttggaaatcataatgaaaacattgattttatatttaagccgagagggtcagactaaaaaaatcgcagaatatataggcacaaaatttgaaaaaagtgcggtacaatctttgcttgatttttctggtgatttagctaccttcgatcgtattattattggtgcctcggttcgctatggtcattttgatcaaagactttatcaatttttgcaaaaaaataccgcacttttacagcagaaagagagcaatttttttggtgtgaatttgacagctcgtaaagaaaataagaatacaccggaaacgaatgtttatgttaggaagtttttgcaacgtattcggtggaaacccaaatatgtaggggtgtttgccggagcgttgttttatcctcgttattcttggtttgatcggatgatgattagattaataatgaaaataacagggggcgaaaccgatgtaagtaaagaaattgaatatacagattgggaaaaagtagacgattttgtactaaaaattagacaaggtgaatgaaaaatcagcttttgattatatatttgaatttttttgcaaagattgcttgcaaggaagtgataattttctataatacgcctcctcctcttttagaggggaatgagaaatgaatatcatagattatttggaaaaattttaagtaatcacttgacatgaggtttcaatctcactaaaattagaagccttgcatttttgatgcagtgtaaattgttctttaacaaactatcagacaaactgtgtgggcacttgtgagactgtattaataagagattaaaagagtaagataagtgcttaaactagagaaattcatagagaaaagatggataaaatagtcagtatttattgagcgaagagattaaattgaagagtttgatcatggctcagattgaacgctggcggcaggcttaacacatgcaagtcgaacggtaacggggagggagattactttctctgctgacgagtggcggacgggtgagtaaagcttgggaatctggcgaatggagggggatagccacgggaaactgtgggtaataccgcgtaaggtctaaggactaaaggggtgggactgagaggccacctgccatttgatgagcccaagtgggattaggtagttggtgaggtaagggctcaccaagctgacgatctctagctggtctgagaggatggccagccacactggaactgagacacggtccagactcctacgggaggcagcagtggggaatattgcgcaatggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttattcaggatcctgtgattttttcagcacaatattcattgtatcaaaaagtaaatcttgcacagcaatcagaacttttttaggagaaatttatgtttttatttcaaaatattgagcatattgagtatgtattcatataaactgatacattcgtcgctaagggtacaattatgtctgaaaatttctcaccactccaatctattgaacctgatctttatcgtttggcaaaagatgctggacatcacctacattcagatccacaatcttcactgatcaaattacgttgttttaccgagcaatttgtactattactctgtaagcagttgcatattgaattagttgataatgaaagcttatcagatcgtatgcgtaaagcagattttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcataccccgacaaaaagtcggggtattacgttttaaatcagcaaagtagctgcttttatagcaatttcaatagctttttgttcagttttatgaatggtttgttcgtttggaatttcttgttgagtacggtttacgattacacctgataccatacctgcacgcagtcccaaagctgaacacattgtaaataatgttgcactttccatttcatagttcatgacattcaatgcttgccattgttttaatgaaccttgataatggcgacaaacttttccgctataggtatcgtaacgttcttgtcctggatagaaggtgtctgatgaggcggtaatgccgatgtgaacactatctctaggttcatttgaaacagcatgatgtaaagcggacatgcaatcaaaatgggcaacagcaggatattctagtggagcaaaatgacggcttgcaccatcaagacgtaccgctcctgtggtaataagaatatctcctacgttgatgtgcggttgaattgcacccgttgtaccgattctgaggaaagttcggatccccagttgtgctaattcttctaccgcaatagaaacggaaggaccaccaattccagttgagcaaacaacgacggctttttgacctatataacccaaccaagaagtaaattctcgagttgaagctaaaaatttcggattatccaatagacgagcaatacgttctaccctttcaggtgcacctggtacgatggctaactctgctccatccaataaggcttttgttaagccaagatgaaagacatcagacataaaatattccttttgtttgttgtaatatctctcagtataaagcacctctgcaatttcatcaattctttcctgttggtataaaatatgggaaggtacaatatgagtgttaaggttggactctaatcttctataagattagaatattccttgaaatataattccacctgttggtagaaaaattgattttttcactgctctttttattagtatttatttttaaaatatcggtaaatgagtatatcatagagtatgtttttatatatttttcatattattttggactatggatataaaattacatttaaatgcaactacgacaccaaaaattcgagcttatttacaaaaatcagataaatcagatcttgagttagcagaacagttaggcatttcggttcaaacggtacgtcgttggagaaataggcaagatgttaatgatcgttctcatagaccgaaaaaaattaatagaactctttcttttgaacaggaatatttgatttgctacctacgaaaatatttcgctttatctttagatgaacttcttgaagctggaagaaatctaatcaatcaaagagtatctcgagcagttattagtcgttgtttaaaaaaatatggtctaaatattgctaataagaaagatttaccatctcaagttggttgtacttttttggcaatgtttcccctgcctaaagagatttctaaagaggaagattatctttttattctaatagagaaattgacaggatatatcagttgtgcttgcttggacagaaaactacagcgtcaacaaagtattatcaattactttaaatctagtttaccttatgaaattcaagaaattgagttagccgaagatattactcatcatgccatagtacaggcttttgccaaaaagactaaagtagttacgtctaccttaattttgcaaagtgcggtgaattttgaacaagattttatacggttagtatcaggttattacactgatagcagattaggatttgatgcacaactattaagatatgaagagtatctgaataagcatcttaaacgaaatcgcttaaaaaaactgtccccttatgattatcttatgaaatatcgccggtaggacagttagtttttttatttttttcgatatagctcaataaattctttgatgatgtccattaacaaaacagcattcattacatgatcttgtgcatgcaccataataatagtgacgggtagtttccccttaccttcatcctgtccgatgagttctgtttgagcgtgatgtgctgctaacaaagcatcatccgcctgtttaagtaatctatctacttcctcaaactgctgttttttagcatgttgtagtgcttccattaaagcactacgacatattcccgcttgaagaattaaattcatcaattgcatttcaagttgctcactcatttttcctccaataaagatagtgcttgtgctaaaattttttctccatcggtcatgccataactcatcatatcaatacaagcgacaggtttgccgaattctgcaccaatagtttggcattcttgcagcttataggaaatttgaggacctaataggacacagtcaaaatcttgtattaatgaacgaaagctttgcatacccttagcttcaatttcaacgggtaaaccctgtgcttcagctgcttgtttcatacgtttaactactaagctggtggacatgcctaaatcacaaataagtaaaattcttttcattttttctccctattttgaaacattatttttcagaaattgataaagtagatgtaatggtttaccgcttgaatagattccttgatctctaaataaggttgtgccgctaatatctaaatgagcccaagtgcagtcattaacaaaccgactaaggaaatatcctgcggaaacacaaatcgccgcattatttggcggagtgttgcaataatctgcaatatggctttccacttggccgagaaatctatcatcacaaggtagttgccatatcgcctcttgtgtttgtattgcggctaaattaagttgatgtagaatttctgtattatttgtcatcacaccggaaatatcataaccaagtgcttttacaacagctcctgttaaagttgcaacatcaataattactgagggtttttgttcagctgcgaatgataataaatcagctaaaattaaccgcccttctgcgtctgtattaataatttcaatagtttttcctgaataagatcggacaatctctccggggcgcatcgctttttcatttatcatattttctgctacaccgacaataatacgtatgttaataggcaatgaattttctacaacggtttcaagtaagccaattaataaggcagcaccacacatatcatatttcatggttttcataccattgcctgtttttaaccataatcctcctgtatcaaaagtgatacctttaccaacgaaacaataggtctgattacaatcaggggagccttggtaatcgacttgaattaaaaaagggggatgtaaaccgcttttacctaccgcatatagagtattcaagccgtagttttgcagatcttctgcatctaagcatcgtatggaaagttgagatttatatgcataactgcttaattttgttgcaatatattcaggtgtcgcaatatcgctgggcagatctgaaattttcctggctgttagcatacctaatactattttgcatagttctaaataattattcgatagttgccgcttttgctccggtgtttccactataacaccaaattcaggcgatgtggcggtctctttaaaacctaaatattttggaaagtaagaaaggttgagataactaataatcaattgttcattgatctgccgttctaattttacggtttcttttccccaatgtaataagattctttgtgcatctgagtgtgccattttttccatcaaaaaatgacgtattttccccattaagtgtgggttttcagccacttcttttttagaaaaaggtaagctatataagccggcattcgatatatttctgcctatctcgattttgctttccatgtccagtatagaaagcagaggtttcaagcagggttgttgctgtaaaaaatctcgatcttctttccaaaaaaacaacaaagcgttttttatctctaattgggtttgccaatcataaagcggaaattcaatgttcattttaactctccatgaatgcggtcaagataagcttgtagccaactttctgaggccggttcatattgtgtaattccattttctcgtttagccagataaatgatagggttatattgctctgttgatacgacaaaggaaaaattatcaatattagttgatacaccgaactctccttgcatattcatacatacaaccgacaaatctcctgctgttccgtaacgttctaataatcgtatttctaattcattgattgtcgtatcagcagcttgttgtggtgtcatcccctctttcatttttcgtacaatttcataactggtgcagcctttcattaagtcttcccccagacctgtagctgttgccgcacctatatgggaatcagcatagaaccctgaacctgagataggcgaatctccaactcgcccatgacgtttcataaataacccactggtagaggtacccacacaaatattattatttttatcaagtgcaataatgcccactgtatcatgcccggaatatggacttaatccacgaccgagagtctcttgatagcgtttttcataaaatgttttaacacggggcgttagcatatctttagcaggaaagcctttctttaatgcccatttttcagcaccgtgacctaccaaaaaactattaaaacgttcatgacttaatgcttcggcaacgagaattggatttgcgatattacgcaagccggctacagctcccaatgccagagaagttccatccataaaggcagcgtccaattcgacatctccctcttcattgggtaacccgccataaccaacagatttatatagagggtaattttctacttgtgtaaccgcagttaaaattgcatctcttgcacttcctttgtttttaagtaattcaactgcctgacaaagtccttcaaatgccatacgccaagttgcaatcatcccccatcttgaattattcatttatacttgtccttctttcattcgatattgcttatcaataatacggaagaatggtaaataaatcattgcagcaatgaataagttgattacttgtataagtgcgccggaaatatgcccagttacaataaaaccacttaaaacaggcggtaatgtccaagggatataaactccggttgtcgtcgcaacaatatccaaatacattgcaacatactgtactgtagtaataactaaaggtgcaagattgaatgggataagcataattggatttaaaataacgggcagaccaaataagacaggttcgttgatgttaaataccgatgagccggcagctaaacgtgacacttttttagcatgttggctacgggcaaaaataagcattgccaagactaaggcgagagttgaacctgaacctcccataaagatcatatcaaagaattgttcggtaatcacatgaggaggtgttaatccattttgcattgctgccaggttttcagcttgattatctaaccagaacggtcgtaagattccattaaccattgaacctgaattgattcctactgaccataaaatatcaatcatgaatacggtcagtaatgcaccgatataagaagtaccaaaatggcgaattggtgtagccagcacggtatatacaaattcatgaatagtattatattcagttttcgagaataaaatccgaatgcctaatactaaaatcataatcaataaagccggtatgagagctgagaatgactgttgtactgccggcggtacgccgtcaggcattttgatcacaatatttttgcgaatgagaaaggcgaataattcggtccaaatgattgccccaagcatagcaataaataacccttttgatcctaaccattgtgttgaaataactgaaccgatgttttcaactttaacaaaaggagtcaaaataaggaaagctgagagagataatataccggaggaaagtttatctatatttagacgttcagcgagtctataggcaaccagaaaagcaataaatatagacattgtagaaaaaacagcattaaagggaatttctatgatattatcccaaccctttccaaaggttgcgctcatgaaatctttatagctttgagatggaaatgaactaattaccagtaaaatagaaccaacaatgataaaaggcataaacgaaatataagcatctcgaattgctcctaaatgacgctgttgggctaatttaccggcagtcgccatcaatttattttcaatttgtttaaacaaggacataataacctccagtaagtaagaaattacaaaacttattgtaggtgatttttgtttgaaaaaagttgataaagatcacaaaattaaaaaagtatcatatgattaattttattttaatgtaaatattattagaatatatttaattttttaaatgtttaatgatgtgatacattttttgaggtttgtatggatatagaaatatgtattgataatattgagtcagcattaattgcacaaaattcaggtgcggatcgtttagaagtatgtggatgtttagcgttaggaggggtaactcctccttatagcttaatcaaagaagtattgagtttatgtaaaattccttgttatgtaatgattcgtcccagatccggagattttttatttaatgcacatgaaataaaaatgatggagcaggacatccacattgcgaaacagttaggagctcaaggtgttgttattggagcattaaccgaaaacggtgaaattgatttatcaatttgccatcgtctaataagtgcggctgaaggtttgggggttacttttcatcgtgcgtttgatctttgtagcgatccttatcatggtttagaacagcttattgaattggggtgtgagcgagttttaacttcaggacagcaaaggacggcatttgaggggagatatgttttaaagaccttggtacaacaggcaaaaggacgaattaagattatggctggtgccggcgttaatccaaataatgccttggaattggtaaaaatcagtaaagttgatgaattacatttatcagccaaaacttttcgtcagagttcaatgaaaggtaattccagtgtgacgatgggaaataaagcagaagatgattacaaaatttggacaacagatcgaaatcaaattattgccataaagaaacttttccaagaatagaggggcataaattttatctggagagcggtgaaaaaaacaaaattttcaccgctcttttttcattattcaaccaactaattttgccgtgaaaatattactaataaccacaacatttttagagaaataaggtagaatacgcccctatttatttttataaagagctttgttttatttatgttatttgcaattggtcagcgttggataagtgaaagtgagaatagtcttggtttgggtattattacgggacaagataatcgtaccgttaccatttcttttcccgcctcggatgaaatgcgtatttatgctttagcaagtgcccctttaactcgagtattgtttcaaaaaggtgatgagattacacaccaattaggttggaaagcaaaagttgttgatgtcatgattcgcaatgagttggctttttatcttgtgcaacgacttgataataacgaagagattgccgtacaagaaatggaattagctcaccaaatttcttttagtaaaccgcaggatcgcttatttagtacacaaattgaccgcaatgagcattttgtattgcgttacaaggcactaaaacaccaacaagaacaatttcagtcctctttaagaggattaagaggaaatcgagccggtctgattcctcatcaattacatattgcacaagaggtagggcgacgtatcgcaccgagggtattattagccgatgaagtcggtttgggtaaaacgattgaagcgggtatgattttacagcaacaattgcttgctgaaaaagttcagcgagtgctaattttggtgcctgaaactttacagcatcagtggcttgttgaaatgctacgtcgttttaacttgcatttctctttatttgatgaagaacggtgtgctgattttgataatccggaagatcatgttgaagcaaatccttttgttgctgaaaacctaattatttgtgctttagattggcttgttcaacaaccgaaacgtgcaaaacaagccttggcgggtgagtttgatttattgattgttgatgaggctcatcatctcacttggtcggaagattcgccaagcgtagcttatgaattggttatgcaattaagtgcggtgattcctgccgtattattattaacggcgacaccagagcaattggggcaacaaagtcattttgcccgtttgcatttattggatcctaatcgtttttatagttatcgggcttttgaaaaagaacagcaacaatatcaacctgttgctaaagcagtacaaagtctgttatcagagcatattttaacagttgaagaacaaaatcatttagcagaattacttagcgagcaagatatcgagccaatgctcaaagtgattaattctcaagctgatacggaacaaaagcaggttgctcgaggagaattaatgagtaatctaattgatcgtcatggaaccggtcgcttgttatttcgcaatacaagacaaggtgtgcaagggtttcctcatcgtatttatcatcaaatcaaattagatttaccaacacaatatcaaaatgcgattaatgtgttgaagatgttgggggaaataaaagatcctgagttattttatcctgagcaaattttccaaaaaatgaatgcggatgcaacttggtggcgttttgatcctagagtggattggttaattcatttagttaagagtttacgtgaagaaaaaatcttagtgatttgtcaagatgcgataacagccatacaattggagcaggcattgcgagagaaggaaggaattcgtagtgcggtatttcatgagaatatgtcgattattgaacgagatcgtgcctctgcatattttgcacagcaagaagagggtgcacaggtattactaacttcttcaatcggttcggaaggtcgaaattttcagtttgcttgtcatttagtgttattccatttgccgaataatcccgatttattggaacaatgtattgggcggttggatcgtataggtcaacgtcgagatattcaaatttatgtcccttgttttgctgatacaccgcaaattcgcttggctcaatggtaccatgaaggtttgaacgcatttgaggaaacctgtccaatgggggctattttgcatgaaaagtgcggtgaaaaattgacagaatttttaacttcggacacaacggacgattttcaggcttttattcaacagactcatcagcaacaattacagctaaaatccgaattggagcaaggtcgagatcgtttattggaacttaattccaatggcggtgagcaggctcaacaattagcgaatgacattgcgatacaagacggttcaacagagctcattgatttcacattgaacttattcgatattattggtgttgagcaagaagatcttggcgaaaaatctattgtcattagcccgacaggaacgatgcttgtccctgattttccgggtttaaaagaagaaggggttactgttacttttgatcgtgatttagcgttggctcgtgaagatcttgagtttcttacttgggatcacccaattgtgcgtaatgggattgatttaatcgtcagtggtgatataggtaaaagtgcggtagctttattggtaaataaacaattacctaccggtacattgctacttgaattagtttatataattgagagccaatcaccacgtggattacagttgactcgctttttacctccaacaccgctacgtttacttcttgatattaaagggaatgatttaagtcatcaaatttcttttcagggcttgcaaaaacaactgaaaccaatgggtaaaaatatggcaacaaaagtcattaaaataatgcgtccagcgattgagcaattaattaagcaaagtgcaaaaaatgtagttgagcaagctaaaatgataattgaacaagctaaacaactggcggatcaatcattgagtgcggaaataaatcgattatatgcgttgcaggcggtcaataaaaatattcgtccagaggaaattgaacagttagaaaatcagcgtacgttatctcttgaattgcttaatcaagcaaattggcgtttagacagtttacgggtaattgtgagtaataaggaataacatggcattaattgattatcgtccccctttagaaccttatttggacattgtatatcgtgatgatcatattctcgtggtgaataaaccgagcggcttgctttctgtatccggtaatcaaccgcaatattatgatagtgcaatgtcgagggtgaaagaaaaatatgggttttgtgagccggcacatcgtctagatatggcaacaagcggcattttgctttttgcaatgagtaaaatggcagatcgagagctaaaacgccaatttcgtgagcgtgagcctaaaaaacattatcaagcattgatttggggacatttagcacaagataccggctcagtgaatttgccgttgatttgtgattgggagaatcgcccaagacaaaaaatttgttttgttcatggaaaaagtgcggtaacaaattttgaggttttacaaagattcaaaaataatatcactcaagtcagattaacgcctattaccggaagatcacatcaattacgcttacatatgcttgcattaggacatccaattttaggcgataaattctatgcacccccacaagcaaaatcgcttgctccacgtttgtgtttgcatgcggaatttttacaaataactcacccgctgacaaaagaagtgatgcaatttagcacaccggcggattttccgatttgagttgctagcataaataatcagcccttaatctatatgattacgggctgtgtgtttataaggaactattgtctatttttataatactcaatagcttgtggcattaattttaataaattcgcttggcgagcatcatcggtggggtgagttgagatgagcttatccagcaaaccttttgaacccccggaggcttttttcattttttcccacaattgtggtgctgctttaggattgtagcctgattttgccatcaggaataagcctacttcatccgcctcttcttcggcactacgtgaataaggtttatttaagccccaatccgcagcaagtccgacaatcagtccacttgcgtcagtgccaaattttgttgataaagcaacatgagcaacttgtgcaactacattagtgaacgtacccaaattcgcttttttcttaccatgttcttttaacgcatgtgccatttcatgccccattactgtagcaatttcatcatcagttaattttaagttgtcaactaaccccgtataaaacaccattttgcctcccggcatcgcccaagcattcatttcttttgatttgataacatttaattgccatgtaaaaacttgcccggtgttgttttctttatctgcataagggcgcatttttttaaaaattttatgtatacgttttgccgtcggtgagcttttatcaaccactccttttgcttcagcttgcccgattatctgcacataacttgaggcagactgttgattaattgaagatgaatctgcacaagcattgagcagtaacacagtaaatatgacaaaaataatttttttaatcgacataatgatatttaaactattaataaaaaaccgctctttgagtaagagcggtttttagagattattttttagcgcgctcgaatgattctaaaatttcttggcgagccgattcaacaccttcccaaccgtcaactttaacccatttacctgcttccaatgctttatagctttcaaagaagtgctggatttgtgcttttaataaagccggtagatcatcaacatctttaatatgatcatattctttacttaattttgtgtgtggaacagctacaactttcgcatcgcctcccgcctcatctgtcatttttaatacaccaactggacgacaacggattacagaacccggttgtaacggatatggcgttggtactaatacatccacaggatcaccatcagaagaaagtgtattatttacataaccatagttcgccggatagaacatagcggtcgccataaaacgatcgacaaataatgccccactttctttatctacttcgtacttgattggatctgagtttgccggaatttcaatgacaacataaatatcatccggtaacgctttaccggcaggtacattttctaaacccatttttcttttccttttacatgttattgatgaatcagattgcggaattatagcgttatttctagggaattgtcgagttatcaacaaagaatcttcttactgaaaaaagtattgtaaaaaagttttgaactattataatagtgcaaaattcaattttcaaaatgaggatctattatgacaaaaaaaatcccttctttatttggtggtgcaatgattattgccggaggaactatcggtgcaggaatgttagccaatcctacttcaactgcgggtgtatggtttttaggttcaacattaatcttaatttatacttggttttgtatgacaacatcaggattgatgttacttgaggcaaatctacattatcctacgggtgccagttttgatactattgtcaaagatttattagggaaaggttggaatttgattaatggtgtgtctgtcgcatttgtactttatattttaacctatgcttatatcacttcaggcggtgggattacgcaaggtttttttaatcaattgttaagtagtacagaaagtgcggtagatattgggcgtagttccggatcgcttatcttttgtattgtgctggcagggtttgtatggttttccacgaaagctgttgatcgtttcagtgtggtattaattgcaggaatggtcatttcctttttcctctctataaccaatctggtcggttcggtaaatacagaagtattgctaaatgctgtacaaggtgaacaacaatatttgccttatgcgttggtggcgttacctgtttgtttggtttcttttggctttcatcaaaatgttcccagtttggtgaagtattatgatcgcaatgcaagtcaggttttaaaagcgattttcataggtacaggcattgcattagtgatttatatcttgtggcagttggctattcagggaaatttaccaagagctgaatttatgccagtcattgaaaagggcggtgatatttcagcattattagacgcattaagtaaatacttacaaacagattatatagcacttacactgaaattttttgcttatatggcaattgcaagttcattcttaggtgtaacgttagggttatttgattatatcgctgatttatttaaatttgatgatagtgttgctggacgcactaaaacagcgttaattacgtttttaccgccattattattgagcttacaatttccttacggctttgtattagccattggttatgctggtttagcagcaacaatctgggcggtaattgtaccggctttattagcgaaagccagtcgtaagaaattcaaaagtagcagttttaccgcttacggtggaaattttatgatatatttcgtcatcgcatttggtttattaaatatcttcgcacaacttgcaatgcagttcggttttttaccggagtttagaggctaaatagcttgaaaaagtaagaaaaataattatcttgttaatgtatgctttatttggcacccactgtagatacgtgggtgcttttctgtaaattttcctagtattagctttgatttgtttgctatagtaggcacaatttttagggagtattgtaggataaaaatggcagaaaaaatcattattgctgaacatcagtttatgcgtacgatttctcgtatttcccatgagattatcgaaaaacatcagtcgcttgatgatattgtgattgttggcattaaacgccgaggtgctgaacttgccgagttaataaagcgaaaaattatagagttcagtggaattgaattgccctctattgatttagatatcactttttaccgtgatgatttagagtatgtggatcaacagcaccagttgcctgtttatagtggagcatccaattatattaatatccagaataaaacggtgattttagttgatgatgtattgtttactggtcgtaccattcgagccgcacttgatgctttagttgattttggtcgagcggctaaagtggaattagtgatttttgtcgatcgtgggcatagagaattaccaattcgtgccgattacgtcgggaaaaatattcccacaagtcgtagtgagcaagttcaggttcgcacaatgcaatttgatgatcgttatgaagttgccttggtcacaaaataacatttgtgaaccttttgcaaaattgctactctaatgaacaaatttacaaacgtcttacagaatgaaaaagcggaataaaaaaatgaaagtatttaatttcaaagcagtgttgttttcaataattggtctacttagcattacgataacagcacaggcggctgaaagggtagtggctaccgttgatgggaatcctattttagaaagccaagtaaaaaaggtgttgggaaaacgagcaaataatgaggaaaatcgtcaaatagctttgaatagtattattgatgatttactagtacaaaaagctattcaagagttaggaatcaaggttgctccagcacatgtagatagtgttatcgaaaatattgccgcacaaaatggattaacctttggacagtttcttgatgtcttagattatcagggcattaattatcaggcgtatcgtcaacagattgcctatcagattttaatatctgaagtgcgtaatcaagccattggcagtagtgtgaatgttactcgtgaagaaattcaagacttaggactaaaactatttaaacaagcgaaaaaacaaggaaaagagaaaaaagtaaccgcacctgaatataatgtacggcatattttgttaaaattgaatcctctgctgaatgatgcacaagccaaagcaaaattaactcaaattcgtgcagatattttggcgaataagataacttttgcggatgccgccttgaaatattctaaagattatctttccggtgcagatggtggaagtttaggttttatgttccctgaagcctatgttccagagtttgccaaggttatcagaacatctaaaaaaggtgtgatttcgacaccattcaaaacagagtttggttggcatattttagaagtaacggatattcgcaatgcggatataacgagagaagcttatatgcaagaagcatatcaacaaattgtgaatcaacaattgcaagaggcatcaggcgactggataaaggctttgcgtaaacgagcacatattcaatattttaattaattatgagatcccgacgcaaagtcgggatttttgttttataataccgccaattttttagcattcacactttcacttatgaagtcaaaaacacatttaggacatactgctcgtaaacgttttgggcaaaatttcttgcatgacaataatattattcaaaatattgtgatggcaatttatccacaaaaagaacaatttcttgttgagattggtcccggtttaggtgcgttgactgaaccggttgccgaaaaagtagagcgtttaacggttattgagttggatcgtgatcttgctgaacgtttacgccatcatccatttttacatcaaaaattaaatgtgattgaatatgatgcaatgcaatttaattttgaacagctttatattgatgaaaacttggctgagaaaaatcagaagttacgtgtatttggtaacttaccttacaatatttcaacacctttgatgtttcatcttttcaaatatcatgcaattattcaagatatgcactttatgttgcaaaaagaggtcgttaaacgtctttgtgcagcaccaaacagtaaagcttatggtcgtttaactatcatggcacaatatttttgccaagtattaccggttttagaagttcctccgaccgcatttaaacctgcacctaaagttgaatcggctgttgtgcgtttaataccacataaagaattaccttatccggtgaaagatttgtactggttaaatcgtgtgactacacaagcctttaaccagcgtcgtaaaactttacgtaatgctttatcaaccttattttcggcggaaaaattaaccgcacttgcaattgatttagaggcacgagccgaaaatttatctattgctgattatgcaagattggcaaattatttagcggataatccgccaacagaagatctgcaatcggagtaaaaatccaagacaaaactgcaagagttaagataataatcaatgacaacattatggcaacttatttagtcggtgatttacaaggctgttatgacgaattacagcttttgttagagacggttcaatttaatcctgtacaagataaactttatcttgttggtgacttagtagcacgaggcgataaatccttagaatgtttgcgttttgtaaaatctttaggggcggcggcacaaatggtgttgggcaatcacgatttgcatctgatttcaaccgcacttggtattaaaaaagtaagtttacaagaccatgtcgaagcgatttttacagcaccggattttgttgaattaattgattggttgcgacatcagcctttgcttgtccatgatgaaaaatgtgattttgtcatgagtcatgcgggcatttcgcctgactgggatttggataccgcaaaatcttgtgcaagagaagttgaaaatgaattacaacatggtgattaccattatttaatcagcaatatgtatgataaccaacctgatcgttggtctgccgatctgcaaggtttgcaacgtttacgttatagtatcaatgtatttactcgaatgcgtttttgctacagggatcatcgcttagatttcgcttgtaaagcgtcagtagaaaaagcaccgcaagaacttatcccttggtttaacttgaataatccgttgtttaaagtacaaaatttggttttcggacattgggcaagtttagtggatacaccgacaccggcgaatatttatgcccttgatacaggttgtgtttggggtaaccgtatgacgatgttacgatgggaagataaacagtattttgttcaaggagcattgaaagattatttttagagtggcaacagtgcaatattatgtcgtgtgcaataatctgaataacagagaactgtagtgcggtgcggttcatataacaatatatgctaagtgtgcggttgtattgtgagtaacgatttttccttgtcgccgctcaagaatttccctgttcatttctccggttttaggctatcctatagcacattttctatatccaatttgcaccgcactttccattatgaataagtcttttagtaaggggtttagcggaaaaagtgcggtaatttttcatataaaaggtaatattatgcaagaacaatatcgtcctgatcttatcgaagcagacgtacagaaatattgggctgaaaagaaaacattcaaagccgttaaagatccttccaaagaaaaatattattgtctttccatgtttccttatccttccggtcgtttacacatggggcatgttcgtaactataccattggcgatgttatctcccgttatcaacgaatgaacggtaaaaatgttttacagcctatgggctgggatgcttttgggttgccagcagaaggtgcggcaattaaaaataaaaccgcaccggcaaaatggacttatgaaaatatcgaatacatgaaaaatcagcttaaagtgttgggcttcggatttgactgggatcgtgaaattaccacttgtaaacctgaatattataaatgggagcaatggttttttactgagttgtacaaaaaaggattggtttataaaaaaacctcaacagtaaactggtgtccgaatgatgaaaccgttttggcaaatgagcaagtacatgaggggtgttgttggcgttgcgatacccctgtggagcaaaaagaaattccgcaatggtttattaaaattacggactatgctgaacaattattaagtgatttagatcagcttcctgaatggccggatatggtaaaaactatgcaacgtaactggataggtcgctccgaaggggttgaaattacctttaacgttgatcattcagatcaaaccttaacagtttatacaacccgcccggatactttctatggtgtttcttatttagcggttgcggcggcacatccgttagctgaaagtgcggcaaaaaataatcctgaattggctgcttttattcacgaggcaaaaaataccaaagtggctgaagcggaacttgccacaatggagaaaaaaggcatggcaacaggattgtatgccgttcatccgatgacaggtaaacagttaccgatttgggtagcaaattttgtgttaatgcactacggtacaggtgcggttatggcagttcctgcacatgatcaacgtgattatgaatttgcacaaaaatatcaattgcctttattccccgtgattaagccggcggataattctgcatgggatttttcaaaacaggcttatactgagcatggtatcactattaattctgctgagtttgacggtttggattttgaggcaacctttaacggtattgcggataaacttgaaaaaatcggtgtaggaaaacgtcaagtaaactatcgtttacgtgactggggagtttcccgtcaacgttattggggagcaccaattccaatgctgacactggaaaatggtgatgtcgtagttgccccattacaggacttaccaattgttttgccggaagatgtagtcatggacggagtaaaaagtccgattaaggctgatcctgaatgggcaaaaaccacttataacggacaagtagcattaaaagaaacggatacctttgatactttcatggaatcttcttggtactatgcacgctatacctctccacaatatcaacaagcgatgttagatgcagatgaagcgaattattggctaccggtggatcaatatattggtggcattgaacatgcaaccatgcacctattatatttccgtttctttcacaaattgttgcgagatgccggtttcgtaacttctgatgagccaagcaaaaaattactgtgtcaaggtatggtacttgcagacgcattttattacaccagcccaaccaatgagcgtatttgggtatcgccgacaaaagtaacgttagagcgtgatgagaaaggtcgtattatcaaagctgttgatgatgaaggtcacgagcttgttcacagcggtatgaccaaaatgtctaagtccaaaaataatggtattgatccgcaagaaatggtggagaaatacggtgcagatacagtccgtttatttatgatgtttgcttcaccggcagaaatgacactcgaatggcaagagtcaggagtagagggggcaaatcgtttcttacgccgcctatggaatttagtttttgaatacaatcaaaatccggcacaaaccgcattagatcctaccgctctttcagtcgagcaaaaagcattgcgtcgtgatgtacataaaactattgcaaaagtgagcgatgatattggtcgtcgccaaacattcaatactgcaattgcggcaatcatggaattaatgaataaactcaccaaagcatcattatccaatgagcaagatcgtgcagtaatggcagaagcattgaatgccgttgtgcgtatgctttatccgattacaccacatatttgtttccaactttggcaagacttaggtaacgaaagtgcgattgattttgcaccttgggtgatagccgatgctgaagctatggttgaagatgaaaaattggttgtgatacaagtaaatggtaaagttcgtgctaaagtaaccgttcctgctgatatgtcggaagatgaaattaaacaagttgctttagcagaagaaaatgtacaaaaattcttgaatggtttaactgtagttaagaccatttatgtaccgggtaaattatttagctttgtagcaaaataagaaaacataaccgcacgtgaaagtgcggttcaatttaggggagtttttatgttcaaaaaaattaaaatagcattactgggcgttggcattttgcttattagtgcttgtggatttcattttcaaaatggtgaattaattccatatgaattaagaacattggtactggaaagcaacgaccctcacagtaaaatgtcaattgcactacgtcgtcaattacaagctaacaatgtgagtatcgttgataatcaaaataatgtcactgttttgcgtctaaatagcacaaaaaatactgagcaggtagcctcagttttcaagcgaggttatgaagcagagaaaattttaaccttagaagtatgggcaacagtgagtttaccgaataaacaaagctatccgatttttgctaatgtcaaccgcactttctttgataattctcgtgccgcattagcaaaatcagcagagaaggagattatttggaatgatatgcgtgaacaggcagcccgccaattaattggcaaaatgattgcattacaaacgcaacttcaaggtaaataatgaaccgcatcttttccgaacagctccaattatcactcaataaacggttgtccactgtgtattatttggttggacaagatcctttattgctgactgagagccgagatgcaattgtacagactgcgatattacaagggtttgatgaaaagttagaaattactgtagataataccactaactggcgttctattttggaacaggctcaatctatcgggttattctttaagcgtcaaatgctgattttaactttacctgaaaatccgaccgcacttatacagcggaatttacaagaactgataacgttacttcataccgatatcttactgattttacagatggcgaaacttactaagccaatggaaaaacaaacgtggtttgaattagcaggacaaaaagagcctcaagctgtgttagtgaattgccaaacaccgactgtcgaccaattgcctcgttggatcagtcagcgtgcatacagtatgaaattagagattgtgccggaggcgataaatctgctttgttatagctatgagaacaatttacttgctttaaagcaggttttacaattgcttgatttgctttatccggatcataaattgacctttaatcgagtgaattcggtcatagagcaatcttccgtatttaccgtatttcaatggattgatacgttgttagagggaaaattagagcgggcagtgcgaattttacaagggttaaaagcagaagatgtacaaccgataattttgttacgtgctttacaacgagagctactcacgattttacaattgacccaaccacaacagcatatcgctaatattgacattccgctggtgagttcacaattaaaagaacggtttgatcgcttaaaagtatggcaaaatcgacgtcctttttttatccaagcgatacaacgtatgacttaccgaaagttgtatatgataattcagcaacttgctgatttagaaagaaaaaccaaggcggattttagtcatgatatttggaatgaattagataatttatctgcaaaaatttgctgtttttagttgaattcacaaaaaatttaggtttattccatatctctactaacgctttttcttggattcatcattttttgtacaaaatatccgttataattcgtcaattaaaaaagttaatacataggaagaaaaatgatacgttttgaaaatgtgagtaaagcctatttgggcggtaatcctgctttgcaaggactcaattttcatttacctatagggagcatgacttacgttgtggggcattccggtgcagggaaaagtaccctattaaagttaattatgggcatggaacgagcaaatggcggtaaaatttggttcaatgggcataatattacacgtttatctaaatatgaaattccttttctacgccgtcaaattggcatggttcatcaggattatcgtttaatcacggagtataccattgctgaaaatgttgcacttcctttaattattagtggtattcatcctaaagaggctgaaactcgagcattggctgctttagatcgtgttggtttgcgtgagcgtgcgaaacattaccctgtttatttatcgggtggtgaacagcaacgagtggatattgctcgtgctattgtgcataaacctcaattattattagccgatgaaccgacgggaaatttagatatcaaattatcgctgggtatttttaatttatttgaagaacttaatcaattaggcatgacggtgttaattgctactcatgatttaacacttgtccagcagaaaccgaagccttgtttggttttggaaaatggttatttacgttaaggaaaggttatggctcatcgtcctatttatgcctcttggtgcgtgcaggtacattatgtactgaaagcagtgttggcagggttaatcaagaaaaagtattcaactttaatgactattttagttattgcggtttcgttaactattccaaccgttagctatttgttgtggaaaaatttatatcatgcaacgacaaaattttctcctaaaactgaattcacgctatttttgcataaaaatctatcggaaacagatgccaatattgttgtagagaaaatacgtcagcaagagggcgtagaaagtttaaattatatttctcgaaaggaaagtttaaacgaatttcgtcatttttccggcttttctgaaggattggatattctggatgataacccgcttcctgctgttgtaatgattaaacttactcaagaatacaatgaaaatactaaacgccatcaactgcgtgaaaatctttttaagattaagggagtggatgatatacgtttagataatgaatggttagaaaaattgaccgcactttcttggctaatcgcacatattgcgatattttgtgccgtattgatggtgtgttcagtatttttagtaattggaaatagtatccgatctgatgtatatagcagccaagcgaatattgaaattatgaaattactaggtgcaacagatcagtttattttacgtccttatctttacaccggcatgatttatgcaatattaggtgcgttatttgccggtatatttagtgccgcactcattggttattttacaagtgcggttaaatatgtcactgatatttttgcagtcagttttacgttgcaaggaattactatcattgagttattgtttttatttgtttgctgtacattaatgggctatttaagtgcttggctctcagcaagtcgttatatgaatttgttacataaaaatattagataaaaagcagaaaatttaaaattcttcgcttttttattaaaaaaacttgattttatcttaaatgttctgtaattaactgagatattctttttacaattcaacacaacattaactaataagggagattatatgaaaaatgtaggttttatcggttggcgtggtatggttggctctgtactcatggatcgcatggtacaagaaaatgactttacgaatattaatccagtattttttaccacttctcaggtaggacaaaaagcccctgtttttgcgggtaaagatgcaggtgaattaaaaaatgcgtttgatattgcagagttacaaaaactcgacattatcgttacttgtcaaggcggtgattataccaatgaagtttatccgaaattaaaagcaacaggttggaatggctattgggttgatgcggcatcggcattacgcatgaaagatgatgcgattattgtattagatccggtaaaccaacatgtgattagtgaaggcttacagaaagggatcaaaacctttgttggaggaaattgtactgttagcttaatgttgatggcaattggggggctgtttgaacgtgatttagtggaatgggtttctgttgcaacttatcaggctgcttccggagcaggtgcaaagaatatgcacgagttattagtacaaatgggacagctggaagatagtgtcaaggacgaattggcaaatcctgccacatcaattcttgatattgaacgtaaagttaccgccaaaatgcgtgcagaggacttctcaacaaccaattttggtgctgcattagcaggcagcttaattccttggattgataaattattaccggaaacaggacaaactaaagaagaatggaaaggctatgcagaaaccaacaaaatcttaggactaagtaataatccaattccagttgacggtttatgtgtacgtatcggtgcattacgttgccacagtcaagctttcacgatcaaactgaaaaaagatttacctttagatgaaattgaacagattattgcaagtcacaatgaatgggtaaaagttatccctaatgataaagaagtaaccttgcgtgaattaacgccggcgaaagtaacaggcacattaagtattcctgtaggacgattacgcaaattagcaatgggacctgaatacttagcggcatttacagttggagatcaattattatggggggcagctgaaccggttcgccgtattttgaaacagttagtgctttaaatttaagagtgtagttaaatttattactcaagttgacactcgttattatttgttatctgaattaaatacagtgataataaaataannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttcatcaacaaatcacaactttttcttcatcagcattcgcatgttcgattttaccgattacccatgctttttcgccgacttgttgtaataatgccaatgcggtttccacatcttcctgtgggagagcgataatcatgcctacgccacagttaaaggttctatacatttcatagcgatcaatatttccttgttcttgtaaccatttgaaaataggatgccattcccaactcttttcattaattaccgctttaacggaagacggtaaaacacgcggaatattttcccaaaaaccgccgcctgttaaatggcaaatagcatgaacgtcagtatgtttaattaattgcaacaccggttttacataaatttttgtcggtgcaagaacttgttcagcgaatgaatgctcggctaattgtgctgttgtcggatcaatacctgaaacttcaatgactttgcgaattaatgaatatccatttgaatgaggaccgcttgaagctaaggcaagtaatgcatcgcctgctttaacgttggaaccgtcaataatttccgatttctcaactacacccacacaaaaacctgccaaatcataatcaccggtatgatacattcccggcatttctgcggtttcaccccctactaaagcacaaccggcttgcacacaaccatcagcaatacctttgatgacatctgctgcaacgtccacatccaatttacctgttgcataatagtcgagaaaaaataacggttctgcaccttgcactacaagatcattgacacacattgcgaccaaatcaacaccaattgtgtcatgtttttttaggtcaatcgcaaggcgtaacttagtcccaacaccatcagttccggatacaagaataggatccttatatttacttggcaatgcacatagtgcaccgaagccccctaacccaccaataacctcgggtctggttgtacgttttacatcagatttaatacgttctactaatgtattccccgcattaatatctacacctgcgtctttataacttaatgattgtttactcacaattgaatcctaaaattagtatcgttattaaaataagcgatattgtaacacgctcaggcaatcgttttcgatgaattttgtaaagaaattttatcttttattcagcaaaagcgtgttgaaaaataaccgcacttttcctcgtctaaaaacgcagaaatgattatctaacgaattttcctgaaaatgatttaatccattagaaaatcatgcaaaatctctgcggtaaattctttccgcaaataaaatcctaaaggcaaagtatcgattatttcgccatttttaccgattcctttggttaacgctcgactatttgcccctttgggacggagttgcaggacctcaccaatacgggctgtaatttctgtgagcttacccagcacaatataatccatcaattcttcccaatcttgacgcagacgttgttcttgagaacttgatggctgccacaaaattggtacaccgacatggcgttcagcaagcggaatttgacgttcaccctcaataggaatccaaagcactttggataatttatatctgacatgagaagagtgccacgttacaccgctattttgggctaaaggtgccaaacttacaaaagtggtttccagaggataaccttgttgattaacaggaattgtttttagctcaatacctaaatggctaaaatcttgttccgctttgcttccggcagttgcacccagtgcggtttcaataagcattccgacccagcctttatctcgcttcaaatcgggaggcacaaccaaatttaactcttctgctaattcagcaaaggttaaacctgcaatagattttgcacgttgtaacagttcagcttcgtgttgagggggagtaagtgcggtcatgattgatgatatttttgtaataactttggtttcacgtattcaatgcctcgatcaatataatcaattttttccaattgcaataaatagcgttttgccggcaagcctccgccaaaaccggtaagttgcttttgttttcctaaaatacgatggcaaggaataataatgctaatcggattacgtcctacggcaccgcccactgctcttacggctttcggatgatcaatgaaacgtgccaattctccgtaactggcggaatgcccatatggaatttggcgtaaagcctgccatattttttgttgaaattccgtgccttgcggatgtaaaggaagatcggaaaaatcttccgcttccccgttaaaataacgatctaatgccgatgttacctgcaaaaagagcggtagattttgattaaaaatccaacgggaatttggctcaatttgttctaattcaaaatcaagatttgtcagctgattattttgcgacaacatcagcaatcgtccaattggcgaatgataataacaataaaaagtaggttgcataaaagaaaaaaggcgtattaacaaaatacgcctgattataacgaatagccgttagaaacggtagctaagatttaaaccgtacaaattggcacgtgctgttgattggtagtccgcacttactacggctaactgtacatttgtaacctgacctctattacccggataagatacagtatttccaatttcatatccctctttaaattgctgttttttaccacgtaaatgagcaaaacctacatcaacagaaagattaggcgtaaagttataggttgcacccaagctataccaagtgcggtcggtatcggggattgaagcactcggatggtcggcagactcatcataagcaatacctgcacgcagggttaatttatcattcacattataagtcgcccctagagctacacgagaactgtcatcaaagttttcatctttatgaaaagcgacctgaccgttatcataaacggcatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccatttatattaattctagattgaacataaacccccccccattgagaattgtttcgttttaaacaaactcattaacgctgggttggttgccacaacagcggcattatcagcaatcgctgcctcacccgcataagctcgtcctaaaccggaactggacacctcggcgagttggaaagctgccgcattggcataagttgtggataatgctagtgctgacgcaataagcgttggcgtaaaaaagttttttgtgaatttcatttttttcataagcaatatagataatcttagttgttaaaagtccatcgaattctaaaacatggttatgacatgagcaaataagtttacgccattaggtaagaggtcagatcagttaaatagggtttatcttttttaacctgttacattttatgacaaaaagagcggtccaaattggcttggaagttggagcaaaattaaaatgatgttaaaatttcaccaattttttaattttaaatcaaggaaataacgatgtcagaaaatgtattgaaatgtactccggaggaaactaaggcttgttgttgtgcagatgtgggaacgattatagataattcggaactcagcgtagacttttctcaagtctatgaaaatgaaacaacagctcaagaggcattggcatatttaacggaaaaagccagaaaagcggaaacggaatcttgtgacattcgtagcgagattaaggaagtaaacggcaattatcagcttaatgcaacgtttacttttagctgtcaagcagaaacgctgatttttcaattatctataagatgattgaacaaatgaggaatcgaaaaaggatcatgttgcccgtagcacgagttaaggcaatatgtaacggtcaagaattgtaacttgttgagaacgtgttcagaataggaaaatgttcaaataatgaacaccccatattatgtcgaggaaaataaatgttttatattagaaaatccaatgaacgtggtcatgccaatcatggttggctagacagttaccatactttttcattcgccggctactatgatcctacatttatgggattttcatcattgcgggtcattaatgaagatcgagtcaaagcagggttcggttttggtacacacccacataaaaatatggaaattctttcttatgttttggagggaacgattgcacatcaagatagtatgggaaatgtgcaaacaatttcagcaggtgaatgtcaaattatgtctgcgggtacgggcataacgcattcagaatttaatccaagcagtacggaaaatttacatttttaccaaatttggattcagccgaatgagttaaatattgctccacgttatgaacaaaaagcgtttgctcatcacgaaggtgcaactttgattttgtcacctcatgcggaaaatggggcattcaaaatttatcaagatatgaaattatggcgttatcaattaagagcaggtactcaaactgatattacgttggatagtaaccgctcttattggatacaagttgttaaaggcactttctttattaatggtcaaacagtttcaacaagtgatggtgtggcaattaaccaagaacgtttagcgaagattgagacggaaaatgatattgagtttttgatatttgatttggcttaaaaatttttgggattcaatgttgagcaaattcaatgttcaagcaaaataaaaatgcctgtctttgatatatttcaaaagcaggcatttccacaatgttcgagtaatgcttaaaaactcaccgcacttttcagttttttcaacgcatttgtttcaagctgacgtacacgttcagcagaaatgttatattttgctgcaagatcatgtagtgttgctttttcatcatctaaccagcgtgatttaataatatcttgactacgttcatccagttcagctaaggcgttggcaacctgatctgctgcttgtgtctcaaaattttcgttttctagctcagccgcaaaatttgagcttttatcttctaaatagagtgctggtgcgtaactttcatcatcatcaacgggtaaatcaaaaccgacgtcagatcctgtcattcgactttccatctcaaggacatcttctttggaaacgcccaattcatttgcaaccatatcaacttctttatcactgaaccaacctaagcgttgtttagttttacgtagattaaagaataatttacgttgtgctttagttgttgcgactttaacaatacgccaattacgtaatacatattcatggatttcagccttaatccaatgtactgcaaaagaaaccagacgaacaccaacttcaggattaaaacgtttcaccgctttcatcaagccgatattaccctcttgaataagatcggcttgcggtaaaccataaccggaatatccacgtgcgacatgaataacaaaacgtaaatgggacaaaatcaatgtttttgccgcatctaaatcttggtgatagtacaaacgttccgccaattccttttcttcttctgcagtcaacattgggtaatcataggctgcgtggatataaccttcgatactgccttgcggaactaacatcattgcttgtgtttctttattcattctattcctttttgtttataaaagacttattttctctatactttaagacttttaattgttttaatcaattaatatcttaaattctaatagttagaccataaatacattaaaaagttttcgtgttattttaaaattggcacaagaacatattctacattttgttcaattacttgcaataataaatcaatatttgggtgcttccccggattttctttagcatctaaaacatgttcggcaaatagttgcacgcctttttccgcacaagtgcggtctaatttaccgttaaatttttgagccaacgcattataaacacgcaaagaacctaattttccctgctcggcaggaatatgatgcacgacttgatcgtttgctaatatatctaaaccggacaagtgttcaatactgggtaagctcgttaaaattgtttggaaatccattttatttctccattattatgaaatataagcagtactatccacttcaccgttttccccaataaagcgtacttccggtcgtaaatagacgttaaattttagtattaccgtttggtgaatatgctgtgctaatttaaccacatccgcactacttgcattatctttattaataatgacgagtgcttgttgctgatgaacagcggcaccgccgatttgatagcctttaagtccggcttggtcaattaaccaacctgctgctaacttaattgtgccgtccggctgtggaaaaaaaggtatagttgggtaatcttgttgtaaaagcgaaaatgcttgtgctgaaataatcggatttttaaaaaaactaccgctattaccaaactcatcgggattgggtaatttgctttggcgaatatgacaaatttcagtaaaaatttcttgtgcattgacttgatgtgtatcgaattcagttaatgtgccgtattttaataccggttgccaattttttgctaattttagaccaactgcggtaataaaatacccttctctgtattgccttttaaaaatactttctcgataagcaaacgcacattcttcattgcttaaacgaaatattgtatttttttgtaaatccaatacgtccacataatcacaaacatctttaaattctacgccataagcaccgatattttgaatgggtgctgatcctgcacaacccggaatcaaagcgaggttttctaaaccataaatgccttgtgttaaggaccattgcactaaattatgccaattttctccgccattaacatgtaaataatgaaagtttgcatcttgcttatgttcaatccccataagctgattaataaatacaatgcctttaaaatcgtccacaaataaaacgttacttccttgtcccaaaaataagatcggcaaagcgttctttttcgctaatttccattgctcaattaactcggaaagtgcggtgatttttataattttttttgctttagacggaagatgaaatgtatgaaagtcttgtaaattttccattaatattccttaaaatgtattcggtaaagttaatttcacttcggtatcgcctgtcgaatgattttgaatagacaagcgtgcatttaattggttactgcgttctaacataatatttaatccataatgcccggttggttcctttaaacttggaataccaatgccattatcacgcacagccaattcatattcaccatcatcattagtataagccagcacttcaatttctgtgccttgtgaatgtttaatcgcatttaatgtcgcctctcgcacaatttgtaacgcatgaactagttgttgggcgttaaatatttgtgaaggcaaagaacaatccactcgcattctcattgaggtttgattgcgtaatgaatctatcacttgttctaaagcaacctgtaaatttgcctcttgtatggttaaacggaatgtggcgagaagttcacgcaactgtagataaccgccggtaactgcttgctcaaaatcttgaataatttcttggcttttggctttggcatcttgagtttcttgttgtagggtatgttttaataaagtgagttgaattttcaaataagacaatacttgagccaaagaatcatgtaattctcttgcgataattgaccgctcttccataagtaataaatgctgttgttgtcgttgcatttggtaaaaatatagcgtgcgactgagcatttgcgagacattgtgcattgtgcgtaaatccggacaaggtaagccggcttgccaacgcataatcccaagttgattattttcgatttctaaatccatactttgtaaatcaacggggtcttgttttgttcctaaagaaatatgccaatgctctgcaccatgaacaattaattctaaataccgcaaatgttcattaatcatcacttgttttagcatttgttgaaatagtttaggttcaatggcttttgtagtaacaagttgagaacaatgataaagcatggttaaagagcggttagcttgacttaacttttgtgttttctcattcactttttcctccaacgtggcataaagtttttttaactcggctgccatttgggtaaaaactaaagctaatcgaccaatttcatcatcacttttggtgtctaacggaatatggttaaattgtccaatttgaacttgagaacttgccaacgctaatttttccaatggggtaacaactcttttgcgtgtaaaataaatgacataggataccatagctaaaatcacaatcattgctactaaaatactgagtacggcgattttaagtttcagctccgcaaaatactgtaaagtatttacaaattgatctacttgatcgacatagctggcgatttctgcacggtaagcatccttgttgttttcttttgcatgcttttccatgatctcccaacgcttgattaaattacgataggattgccttacatcattaggtacaagaaaatgccgactgattttgagtaatggttctgaatgcaaacttaaacgatattgacgtaatgccctctctacattgtccggttcatattccatttcataaaaaagtcggtaactttgcatatgtaatgagctggaaacattgattaactctgcatcagatttattactttgcataatagctaaactcattatgctaattaacgatacaaaaataatgatgagcaataaatagttggcaattttagttgaaacagaatgattttttatattcatataaacgtttttaagcaaaaatctcaccctatcatacaacagaatgtattgaataccgcatactttattattcatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnataaatttgatctacctcaacaaacttgcattttgtcgagcaaatactcatttttggttattaaaaatcagcggtaaggtttggacaataaaaatctataaaagaatagtgtggtttttaggcataacgttggtggaagaacagttatccggcaacgataacaacctcaaaataagaaagaatatgaaagaaaataaaaacgcaaaaaatcatgctgaggagtggcatgtttgtggcttgattattcaagtaaacccacaaaaaatagcacaagttaagaccgctcttttgacgattccgcatacggaaattccagcagaggatgaaaaaggaaaattggttgtggttatgcaatcggacgatccacaggttttactgaatcatatggaaaattcacgcaatattgatggcgtgattgatttgtcgctgatttatcatcaacaagatgacaatgttgagcaataatttaaaaatgaatagtgggggagactatgaatttaagtcgtcgtgattttatgaaagcaaatgctgctttagctgccgcttcagtggctggcttaattattccggtaaaaaatgtaaatgcagctgacacaagtattacttgggataaagccgtatgtcgcttttgcggtacaggatgtgcggtattagtggggacaaaagatggacgtgttgttgcttcgcaaggtgatcctgatgcagaagttaatcgagggttaaactgtattaaaggttatttcctacccaaaattatgtatgggaaagaccgtttaacgcaccctatgttacgtatgaaaaacggtcaatatgacaaagaaggggaatttacccccgtaacttgggattttgcctttaaaacaatggcggaaaaatttaagtctgcattaaaagcaaaaggaccgaacggtgtaggtatgttcacttccggacaatccactatttttgaaggtgtggcaaaatcgaaattattcaaagcaggattactttcaaacaatattgatccgaatgctcgtcactgcatggcatcggcagctgttgcttttgtacgtacctttggtatagatgaacccatgggctgttatgatgatattgagcatgccgatgctttcgtgctttggggttcaaatatggcggaaatgcatccgattttatggtctcgtatctcggatcgccggttagctaatcctgatatggttagtgtaaatgtcctttctacctttgagcaccgctcttttgaacttgccgatttaggtattcttctcaaacctcagtctgatttggctattttgaactatattgcaaattatctcattgaaaataatgcaattaatcgagagttcatcgaaaaacataccaaatttaaacgtggcgaaactgatattggttatggcttacgtccacaagatcctcgtgagcaaatagcgaaaaatgttaaaactgcgggcaagatgtatgatagttcttttgaggaattcaaaaaattagttgcaccgtacaccttagaaaaagcacatgaaatttccggagtaccgaaggagcaattagaaaaactggcaaaactttatgccgatccaaataaaaaagttgtttcttattggacaatgggcataaaccaacacacacgtggtgtatgggcaaaccatttaatttataacattcatttattaaccggaaaaatttcattaccggggtgtggtcctttctcattaacaggtcaaccctctgcttgtggtactgcacgtgaggtgggtacttttattcatcggttaccggcggacttagtagttattaaaccggaacatcgtaaaatcgcagaaaaaatttggaaactaccggaaggtttgatttcagataaattaggcttccacgctgttgcacaaagtcgtgcattaaaagacggcaaaatgcaggtgttatggcaaatgtgtaataacaatatgcaggcaggtccaaatatcaatgaggaaacttacccagggtggcgtaatccggataactttattgtcgtttcagatccctatccaaccgtatccgcactttcagccgatttgatcttaccaacagcaatgtgggttgaaaaagaaggggcttatggaaatgcggaacgtcgcactcaattttggcgtcaacaagtgaaagcaccgggtgaagcaaaatctgatttatggcaattagttgaattttctaaatattttacgactgatgaagtatggccggcagaaattttagcgaaaaatccggcataccaaggtaaaacactttatgaggtgctttatctcaatggacaagtaaatcaatactcaaatgatgaactgaaaggtcgcctaaatgatgaggcttaccattttggtttctatatacaaaaagggttatttgaagaatacgcaagttttggtcgaggacatggtcatgatttagctgattttgacacttaccataaagctcgaggcttgcgttggcctgtagttgacggtaaagaaactttatggcgttatcgtgaaggttatgatccttatgtaaaagcaggggagggtgtttctttttatggtcaggcggataaaagagcggtgattttagcggtaccatatgaaccgccggcagaggttccggatagagaatatgatttatggctgaccacaggtcgcattcttgagcattggcatacaggctccatgacacgtcgtgtaccagaattacaccgttctttcccgaataaccttgtttggatgaatccgaatgatgcgaaaaaacgtggtttgaaacatggggataagattaaggttatttctcgccgaggtgaaataacgtcttatatagatactcgtggacgtaataaatgtcctgaaggtttgatttatacgactttctttgatgccggacagctggcaaataaactgatattagatgcaacagatccgatttcgaaagaaactgacttcaaaaaatgtgcagtaaaagtggtgaaagcgtaacaatcaacaaaaggcaccgcactttacttgctaaagtgcgatgaatactcatgaagaaaattgcttttacaccggaacgccgaaaatttttaagagataccgtccgaacctgtggcggacttgccggattaggcgtattacttggcttacaacaacatcaaagtctggctagacagggtgtggcattacgtccgcccggtgctttggctaatgaccaagattttacagcggcttgtattcgttgcggtcaatgtgtacaggcttgtccttataaaatgctgcatttagcctcattattatcttccatagaggctggaactccctattttattgcgagagagaaggcttgtgaaatgtgtgaggatattccttgtgttaaggcttgtccgagcggtgcattggataatcaacttgatgatattagtaaagcaacaatgggattagccgttttgcttgatcacgaaacctgtttaaactggcagggtttacgttgtgatgtttgttatcgtgtttgccctttaattgataaagcgattacgttggaaactcatcgcaatgagagaacaggaaagcatgctgtgtttattccaactgttcactccaatgcttgtacaggatgtggtaaatgtgaagaggcttgtgtattggaagaagccgctatcaaggttcttcctaatacattagcaaaaggtatgttgggagaacattatcgtttgggctggcaagagaaagataaagtagggcattctcttgcaccaaaagacttaatatccttaccaattcgtcaaccggagagtaaataatggcaaattctcctaaacacagcggtaaagaatcaagagaaaaattaggtttttggcgtgcaaaccggttcctcattttacgtcgagtaactcaattcagcattctcaccatgttcttgagcggaccttatttaaacttttggattctaaagggtaattatagtggtggtttattattcgacactatcccattaaccgatccgcttattgtcgccgaaagccttgcaacaggttatttaccgaacagttcaacgattattggaacaattattgttgtatcaatatatgctttacttggtagcaaagttttttgtggctgggtttgtcctcttaatgttgtaacggattgtgccgcttggttacgtcgaaaattaggtattcgtcaaagtgccaaacttcctcgtggcttgcgttatggtattttgctgatgattttaatggggagtgcagtaagtggcgtattgttatgggaatggataaatcctgtttccgctttgggacgtgcgttaatttatggggttggtgcaacaactttgttgatattggcagttttcttatttgacttatttattgtggaacatggctggtgcggtcatctttgtcctattggtgcaatttatggtgtgattggggcaaaaagtttattgcgtattaaagtagttgagcaacaaaaatgtgatcactgtatggattgttaccatatttgtccggagccgcaagttttacgtgcaccgctacacggtaaaaataatgaaagtcggtttgtactttcaaaagattgtatcagttgcggacgttgtattgatgtctgtgctgaaaaagtatttatatttagcaatagatttaattattctgggagtgatcaaaaatgatgaaaaaaacactattatttattaccgcactttttgtgtcttctgcttttgcaacgcagaaagtgggaaaaaactaccaagatgctgttgaaaatgtgccagctgcatttcataaccatataaaagaaagtacaacgcccgcattaaactatgtaaatcaaccacctatgatcccgcatagcgttgcaaattatcaagtaacaaaaaatacaaaccagtgtttaaattgccatagtccggaaaactcgagaattaccggagcaacaagaattagtccaacgcattttacagatcgtgacggcaatgttaccggtcaaactgcaccacgacgctatttctgtttacattgccacgtatcgcaagcagatgttgctcctattgtgccaaatgaatttaagccaatgaaaggctatggtaactagatgaggatagatgtatggcaaatgaaaaatcaaatatcatcgttcgtttaagtaaaagcggttggaaatggtttaggaagccaagtcgtgctgtcagtgtattgattttattatcatttattgcaggtattattttttggggagggtttaacaccgcatttgaatacacgaatacggaagaattttgttccagttgtcatatgaatgacgttgtacctgaatatcgtcattctgttcactatatgaatcgcagtggagtaaaagccgactgtgccgactgtcatttaccgcacgaatttattccgaaatggacacgtaaaatcggagcggcaaaagaagtttatgcgtatattacaggcaaggtagataccaaagagaaatttgaggcacatcgcttagaaatggcacaacgtgaatgggctagaatgaaagccaatgactcacaagaatgtcgtcattgccataatttcaatgatatggatactactcagcaaaaaaatgtcgcacaaaaaatgcacagaatggcacaagaacaaggaaaaacctgtattgattgtcataaaggtattgctcaccaattaccgaatatgaaagacgtgcaatccggttttttacctgagcaatagtgaaaaaattgaccgcacgttgagttgcacctccaacgttggatacatccgactgattgaggtgcaacattgtgactatttgattttaaattatttatcctaatgcaactctcgcattttggaataaacgcatccaagccccgtcttcttgccaattttcaggataccaagaattgtttactgctctaaatacacgctcagggtgtggcatcataatagcgactcgtccgttggaattagaaagtgcggtaattccctccacagatccgttcggatttgccggatacatttctgtcggatttaactgactatcgatatattgtgcagcaatcaaattctgtgcttttaatgcttgcaactgctgatcatgcttaaattcaattcgtccttcaccatgagaaaccgcaatcggcatatgtgatcccgacattccgttaaaccatacggaatgagtatcgttaatgcgaaccattgcaacacgagcttcaaaacgttctgatttatttcgtacaaatcgtccccagttttccgtaccgggtataatttctgctaaattggataacatttgacaaccgttacaaacacctaaggctaatgtgtcctgacgatggaaaaatgcactgaattgatcacgaagtgcagtgttaaacagaatagatttagcccaaccgccaccggctcccaagacatcgccataagaaaatccaccgcaagcaacgagtgcgttgaaatcctgaagatgatgacgtcctttttgcaaatcattcatatgaacatcaatggcattaaatccggcacgatcaaaagctgccgccatttcataatggctgtttaccccttgttcacgtaaaatagcaatacgaggttttgttcctttttggatataaggtgcggtgattttttcatttagatcataggtcaaataagcggaaagtcctttatcattcggatcttttttcatctcaaattcttgatcggcacaatccggattatcacgtaaacgttgcatttgatgtgttaattcagcccaaatcccacgtaatacggaacgtttttcactcaataagactctggtactgcgagtaatctcgatatgatcatctgcggtaacaataccgagttctttggttaaatgaattaatccatgttcggtcaatacggcacgcaccgctttaaggtcactttctttgacttgaattacggcacctaattcttcattgaataaaacaccgagatcattgtcacccaatgcactgatgtctatggaaataccgcaatgaccggcaaaagccatttccgcaagcgtaacaatcaaaccaccgtccgaacgatcatgataggccagcaatttctcttgtttcacgagagcttgcattgcattaaaaaagcctttcagcaaagacacatttactacatctgccggtacatcgcccaattgcttatacacttgagcaagtgcggttgcacctaaacgattttttccctcacctaaatcaattaatagtaatcggctatctcctttgtccatacgtaattgaggtgtaaccgtcttacgcacatcttctacacgagcaaacgcactgataattacggaaagcggtgcggttacggatttttgatatccttcttcctgccaagtggttttcatagacatggaatcttttccaaccggaatggttaaacctaattgagggcataattcctcaccgattgcttttacagcctcataaagtccggcatcttcgccgccatgacctgcggcagccatccagttagcggataatttaatccgtctaatatcgccgatatccgttgcggcaatattggtaatgctttctgcgacagctaaacgtgcagaggcggcaaaatccaacaaggcaacaggagttcgttctccgatagacattgcttcaccgtgataactgtctaaacttgctgttgttaccgcacaatccgccacaggtacttgccacggaccgaccatttgatcccgtgctaccatacctgttactgagcggtcgccgatagtgattaaaaatgttttctctgctacggcaggtaaccgcaataccctgaacaatgcttctttaatttggatcatagactgatccaattggggattattgacttttgcggatttcacattacgtatcattttaggggttttacctaacaagatgttcattggtaaatcaataggattgttattaaaatggctatcttgcaaagttaactgctgttgttccgttgcctcaccaatcaccgcaaaagatgctcgctcacgctgacaaatcgcttcaaagagcggtaatttttctggtgaaacggctaaaacataacgttcttgtgattcattgcaccaaatttctaacggcgacattcctttttcatcgcataaaatttttcgcaactcgaatcgaccacctcgaccaccatcatgaactaattcaggcatcgcattagataacccgccggcaccgacatcatgaataaaaagaatggggttttctgaacctaattgccaacaacggtctattacttcctgacagcgacgctccatttccggattatcccgttgtacagaagcaaaatccaaatcttcttttgactttcctgatgccatagacgaggctgcaccaccgcccagaccaatattcattgccgctccgcctaacacaattaatttcgcaccaacaggaatttcgcctttttgcacatgttcatgacgaatattacctatcccgcctgccagcataatcggcttatgatagccccgcacttcttcgccgttaaaactgttgactttttcttcataagtacggaaataacccaataaagcaggacgcccgaattcattattgaaagcagcaccgccaagcggaccttcaatcataatatccagtgcggaggcaatacggctcggtttactcaacgcattttcccaaggttgcggaaaattcggaatacaaagattagacacggagaaaccgactaaaccggctttcggttttgcaccacgtcccgtggctccctcatcacgaatttcgccacctgaaccggttgcagctccggggaaaggcgaaatggcggtagggtgattatgggtttccactttcatcaaaatatgcgtgtcttcttgatgataacgatattgcccgtcttggtcagggaaaaagcgtccgacttttgaaccttccatcaccgcagcattatctttataagctgacaatacataatcaggcgttttctcaaaggtgtttttaatcattttaaacagcgatttatcctgtttttttccatcaataatccaatctgcattaaaaatcttatgacgacaatgttctgagttcgcttgtgcaaacatataaagttcaacatccgtaggattgcgaccgagtgcggtgaaattttccactaaataatcaatttcatcttttgctaatgccaatcctaaagtaacattcgccttttccaatgcaacatgcccaccggttaaaatatctaccgtggtgaaaggttttgggtcatgctgttcaaataaaacagctgcttcttgtggagaacggacaatactttccatcatagggtcgtagatacggaatactaattgttgttcttcttcagccgttaaagtgcggttaaatttgaaataataagcgataccacgttccagacgaagtaccttatttaaatcacaattatgtgcaatatcagttgcttttgatgcccaagaagaaatcgtacctatacgtggaatcaccacaaaacattccccataaggctcttgcgatttctgagtcggaccataacgcaaaagctcctctaatttttctctttctatctcagttaatgcttcacttaaatgggcaaaatgcaaaaactctgcataacaagacacaatgggtaaattatcttgctgaaaaccactgaataactgatttaaacgaaaattggataatgcgggcgtaccacgaaaaatgtgtaacatagaaaagatccatcaaaaaaataaaaaacgaccacattataaaggaatttttatcggaacgaaaacgtttgcctaatgcaattttcaaaaaatagttaataaaaagctgataactgaaatgatctgcaccccaaaagttggactaaacaactaactgatgaagtgcagatttttttaggattaattttttggtaaatatctcattggatctactgattgacctttataacgaatttcaaaatggagtttgattgtgtttgttccagaacttcccattttagcaatttgttgacccgctttaacttcttgctgatctttgacgagtatagtttcattatgtgcataagcacttaaataactgtcattatgtttaataataattaaattaccatatccacgtaaagcgtctccggcatatacaactcgtccagcagcagctgcattaacagcttgtccacgagaaccgctaatatcaatacctttattgcctccatcagcactggaaaatccttgaataatttttccatttgttggccaaatccaagctatatttgaggtggctggaggtgttttattgattggcattgttgaatgtgttggtgtagcaacggggttcatttgttcatttgttggtttattagcattccatgtctcattgactgtattttgtgtcacctctgattcatttattgtctgtgttggtatcatattgctatcgggaatattatttgcaattttcaatatttgtccaatactcagatgatatggctcagacatattatttagtgtggccaattcttttatatccatgcctgaaatataagcaataagaaacatggtatcgcctttgcgtactttgtaagtatcacctttgtaaaaacccttatcaattttgctataaacaggcacattagttttaggatctcttggaatttcaaaattttgtagagcctgtttttttgctatcgattctgttttttgttgattttgttgaatgatttcaggttgataagtggaatttgttgctttcggcactctcatactttcgggcatcttttgttgaataacttgaggttcccaagcggttgagtttgtaccattaatcggtttgataatacttggtgctaaatccttagcattttctaccggagccggagtgtgtgaactacaagcagctagtacagtgatactaatagataaaggtaaaaattttttcatgtaaattctccgttactttatattcattttttatcttagattatttcaagacaagatatacaactatagcaataatgacaactgaccaaccgataaattcaatagattgacgtaatttcgcagcaaatttttttccgctccaagccgctaaatgggtaacgagcgaaaatcttgcaatacgagaaataaaggcagtaagtaagaaaggcaaaaatgccatttgcatgacgcctgcacaaatcgtaaaaattttataaggaataggtgaaaaacctgcaacgaaaactacccaaataccccattctttgaaccaagaaagagcagtttcccaatgttgttgataaccccattgttgaatataactttgtatgaaatcaaaagcgtaataacctaatccataaccaattgccccaccaatggctgaagccattgctgcataaaatgcaaatttagtagcacatttaggtttatttattgacatcggaataagcatgacatcaggtggtatcgggaagaaaatagcctcaataaaactaacaaaagttagccaaaatgtagcaaaacggtgatttgcccattgcatagttttatcatatagcgtaccgaaaattttcatgttttattccttcgatgaaaagattatcgttattccttatctaaccattgttgtaaagctgtcattgaatgatatgccgtcatatccgtttgaatgggtgtaattgacacatagccgtttttaacggcatggaagtccgttccttccgattcattttctgccagtcctattggtccaatccaataaatctcttcacctcttggatctttttgtttgataatatccgctgcagctgcacgatacccaagatgacaaactttaataccttttatttctgaataggggagatccggcacattaatattaataatttctcggctttttaataatcgtccatatagtttaggaataagttgactcacaattattgctgcactttcataatgttgtcgtccatctaaagaaactgcgattgcaggtaagcttaaatggcgcccttccagtgcagctgcaacagttcccgaataaataacgtcatcacctaaattgactcctgcattaatacctgaaacgacaaggtcgatctgaccggataaaaaaccgttgagtgctaaatgtacacaatctgcgggagtgccattgatactataatcaccattatccaatttcattggtcgtaaaggctcaacgagtgtgagtgagcttgaagcggcactacgattacggtctggtgcaacaacagtgacttgtgcaaatttacgtaattctttagcaagagttttgattccctctgcctgtatgccatcatcattagaaagcagaatatgcatattgtttcctatgttttaaattattattcattaatattaaccagttctcttacgagggctgtcgcataacttcctgctggtaaataaaaagtcagttttaatccctcaggtataaatgaccagcttaagtgttgagcttgcataagtattggacgacgtgccgatttcattttttcctggtgcattaagtacaggagttcttgatgtttagcgataatttcattttctacatcactggcaatttgtacgttttcaccaattaatggtgcagtgatttgaatatcctgttgtgctaaacgttgttgtaataaattaaaatcttctttttgatcagcatggaaccaactgtgtgagccggataactgcaaaatatcatttactaagattttatggtgtagaccttgttgaatacgagcggatacaatcaagttaaaaatttcactacgagcagcggagagataaaaactacgctttttgcgatctttaactttaatttcacctttagcccagcgtaaagcctgagttaaattgtgtccatctcgtccgaaacgttgctcggtaaaataatttgggaacccatttttcttgatattttctaaccgcactttgagatctgcatcttcttgtgcttcacgcagtaaaatttcaaaatggtttccgtctaagcttcctgtgcgaatttttcgattgtgacgtgttacctcaaggatttccacaccatcaagttgaaattgattaaagtcaggtgtgggttgccccggcatctgtaaacaaaaccattgttctgtaatcgctttacgatctttgagtcctgcatatcccatatttttagcaggtataccggcaaattgtgccaatttctctgcaacaaataaagtattgcagtctgttttgcgtaccttaacagcaacaaattcgccatcaccggacatttcatagcccagttgttctttcacaacaaaatcagcacagtgtgtttttaaaagtgcggtctgttttggcattgtttgtaaataagcgagttcgttcattactttgtgccattttgttttattaatagggcaacagcttcacaagcaatgccttcaccacgtccggtgaaacctaatttttctgttgtagttgcttttacattaacctgttcaatatcacaatgtaagtcctgtgcaatcacagtacgcattgagtcaatatatggacgcatcttgggagcctgtgcaatgatagttatatcaacattaccgacttgatagcctttgtctaaaattgcttggtaggctgttcttaataacctgcgactatcagcacctttatattgtatatcagtatctgggaataattttcctatatctcctaaagccattgcacccagtaaagcatctgttaatgcgtgtaatgccacgtcgccatcactatgtgcaactaaacctttttcataagggatagcgacacctccaatgataataggaccttcaccaccaaaggcatgtacatcaaagccatgaccaattcttatcatattttttcctaattaatgctcttttttcataatttgttggatttcagccatcatttcttggtcgacatctaaggctatttgaattaattctttattttcaaagcgagagagttttggatcataaacctctgccatcagtttcacgctatgacaatcttttctaaaatacacatcaccaatttctgccactatatcttcgttcatacctaaagagagtaaggcttgtttacttgttcttaatgccgaatcaaaggtttcacgaatttgaatattggcacctgcaccatacagattgtaaacatgaatacggtcgtgagcacgtgcaataattttaatttgtgggttcattttacgagcttgctcaacaatttgtagagtttgttcgctgttatcaattgctacaatcaataattcggcattttcgacaccggcagcatgtaatagctcaggacgagcagcatctccatagtagcatttaatgcctaattttttcataccggcaattaggtttgcgtctttatcaataatagttgggtggtgccctgtcatcactaacattctatttacaacctgtccaaaacgtcccagaccaattagtatagttggatgttgttcatcaatatgatccgcttttctttccggttgagtcggtttgagacgaggaataatgtatttcttttgagcaataataaagagcggtgttaaaatcattgaaagtacaacaatggctgtcatattcgcttgcatttctttactaatcacattttggctggctgctgaagaaaataatacaaaggcgaattccccaccctgtgccataataaatgctcggtcaatagaattagcattaccggtttttgtgattaaagcgattaaataaattataaatcctttcactaacatgaaaactagtacaccaaaaataattaagaaccaattttcagcaacgacggaaaggtcgagtgacataccgacacctagaaagaacaagcctaatagcaaccctctgaaaggctcaatatcagcttcgagttgatgacgaaaactggattctgaaagtagcactccggctaaaaaagcacccatagccatagagaatcccccctcttccataagtaaagcagagcctagaacaacgagaagagcggctgcagtcattacttctcgagttttggttttagctaaaattttgaacaatggatttaagagccaaagtccggctgccactaaaacagcaaaagccgtgccggatattgcaattttatgccaaagcggatcagttgaagtaactttatccggtgataaaaaagccacaaaagcaagtaatggaacaatgagtaaatcttcaaagagtaaaatcgaaataatacgctgtcctcttggagaggtcagatcattacgctcactcagttcttgcattacaattgcagtagaggtcaatacaaaaccggaggcggcaacaaaagcaactttccaatcaaagccaaataaagtagcaatataagttaaagcactggtacaaagggtaatttgaaatgcacctaagagaaagatatggttacgtagtccccagatatgagagggtttcatttcgagtccaatgatgaataaaaacatcaccacacctaattctgctatatggattattccctctggatctgtaaagagaccgaacccaaagggaccaataactaaaccggcggctaaatagcccaatactgaacctagtcctaagcgtttgaatagaggaaccgcaactacggccgccgctaaaagcgtaacaacgctaacaagtgggtttgccccttctgctaccataataattacctttgttttctagttaaaaaaaattctgccaatgccaagtcttcaggacgtgttactttaatattatcactatgacctgctactaagtgcggtctaaatccggcaagttccatcgctaatgcttcatctgtgacgataatacctcgttttgctgcttgctctagagcgtgttgcaataagtgtacagggaaaaattgcggtgtttgtgccaaccataattgattacggtcttctgtacattgaatttgcaatactgaatttgatcgtttaatagtatctaccgcaggaatagctaaaatagcaccattttgatcttcaacttgtagtaatgtatctaaatcttcattgcgtaaacaaggacgtgctgcatcatgaacaagtacccaggcttttttatttttaatgtgacgtaggccgtttagcacggattccgcacgattctttccgccaataaccatattgatacgaggatttcgcaataactcaatatcaattaaataaggatcattttcagcgacagataaaacaatttggctaattttttcgcaactcaaaaaaatacttaatgtatgctctaaaattgttttgcccagtatctttaaatattgttttgggcgatctgcttgcatacggcaaccaatgccagcagcaggtattatagcaacaatttctctatccatttatctattcttattttttactatacgataaaaaacttcattttgcttgatcatttcatgttccattctggctctttcctcgattgcttctataccattcttcagatcctgaatttcagcaaaaatagtttgattacgttgtgacagctttttgttttcttgtttacgttggataatttctgctttgatatcttgataatcgagatagccattttttccaaaccaaaaatcatactgaaacataactaacaaagcgaaaagacttaaaataaataaacgcatttttatctcttatttttcataccaaattttatttatgtacaaagaaactatacctgagggagtggctactttgatttcgtcatcgacttctttgccaattaatgctcgtgctacagggctatcaatggagatccaattctttgcgggatcaaattcatcacaacctacaatgcgatattgtttttcctctccttgctcatcttctaaggcaacccatgcaccaaaaaagactttaccttcttgctttgggttatagtccacgatttgcaatacttccaaacgtttcattagaaaacgaactcggcgatcaatttctcttaaacgacgcttgccgtaaatatattctgcattttcactacgatcacccaaggcggctgcatcggaaacagcttgcgtgattttaggtcgttcgtctttccataaatattttagctcttgatctagaatattccagccggaacgagtgatataattagatttaggcattgtatctttcctttcaaagagagcaaaattgtaacataagatcaataataaatatgtgaagaatagttaaaattacagttaattttacaattttttccaataattgtttgaactattacgttaaactcagtatgctaccgcgaattttttaaacagaatataatagaaatagagacaagatgttaaatcaacaaatcgccagtattattgcgaaagaactaactgttctgccaagtcaaattttatcggctatccaattattagatgatggcaatacaattcctttcattgctcgttatcgtaaagaaatgaccggtggattagatgatacccaattacgtcattttgaaacacgtttaatttatttacgtgagttagaagatcgtcgccaaacgattctcaactctattgaagaacaagggaaattgacagatgaattgcgtagtcaaattgaacaaacgcaaagtaaaactgaattagaagatctttatttaccgtataaaccgaaacgtcgcacgaaagggcaaatcgcaattgaggcaggaattgaacctttagctgatttgctttggaatgcacctgagaatgaaccggaaatcgttgcggcagattatatcaatgcggaacaagggtttgcggatataaaatctgtgcttgatggtgctcgttatattttaatggagcgttttgccgaagatgcacaattgttagcgaaaatccgccaatatttacagaaaagtgcggtactggtttccaatgttttagaaggcaaagaggctgagggagaaaagttccgagattattttgaacatcaggaattactccgcaatgttccttctcatcgtgctttagctatgttccgagggcgtaatgaaggctttttgcaattaaggttgaatgcggatcctgagcaagaagaaggtgttcgtcatagttattgtgaagaaattattcgagagcatttgggtattcatttaactcagcaaccagcggataagtggcgtgagcaggttatctcgtggacttggcggattaaaatctctttacatcttgaaactgaactgatgagcagtttacgtgagaaagctgaagatgaggcaattgatgtttttgcccaaaatctaacttcattattaatggcagcacctgccggagcgaaaaatactatggggctagatcccggtttaaggacaggtgtaaaagtcgctgttgttgataatacgggaaaattagtggcaacagagatagtttatccacataccggacaaatgaatacggcaatgtcagttatttatcaattaattaagcaacataatgttgagttaattgccattggtaacggcacagcttcaagagaaactgaacgatttgctaaagatgttattaagaaaattgagcaaaataaaccacaaacagttgtggtcagtgaagcaggtgcatctgtttattccgcatcagaattggcggcacaagagtttcctgaactggatgtgtctttgcgaggtgcagtttctattgctcgccgtttacaagatccactggcggagttagtgaaaattgaaccgaaagcaattggcgttgggcaatatcaacatgatgtaaaccaaactcagcttgctcgtaagctagatgcggtagtagaagattgtgtaaatgccgttggggttgatttaaatacggcatcagcacctttacttgctagagttgcgggtatgactaaacatcttgcacaaaatattgtggcatatcgtgatgaaaatgggcgttttgaaagccgtaatcagttaaaaaaagtaccgcgtttgggtcccaaagcctttgaacaatgtgccggttttatgcgtattgcacaaggtaaaaatccgcttgatgcctccggtgttcaccctgaggcttatcctgttgttgaaaagattttacaggctacggaaaaatctattcaagatttaatgggaaatgtgagtgctgttcgacaattagatgcaaaacaatttactgatgagcaatttggaatgccaacagttttagacattttcaaagagttggaaaaacccggaagggatcctcgaggtcaatttaaaacggcagtatttatggacggtgttgaagaaatcactgacttaaaagcaggtatgattttagaaggatctgtaactaacgtaacgaattttggggcatttgttgatatcggtgtgcatcaagacggtttagttcatatttcatctctttccgacaaatttgtggagaaccctcatgaagttgtgaaaacaggcgatattgtgaaagtcaaagtgttggaagttgatgttgcccgtaagcgtattggactaaccatgcgtttagatgagaatccgcccaaaaccgaccgcacttcagtcaaaacgacctcagtccatgtaaaagaagtgaataaaaatcggaaaagtagcaataatgttatgggaaatgcgtttgccgatgcgttaaaaaattggaaaaaatagttttagtacagggtatttgggtattaagttatgatgggtttaattgtataacacaggaaattttatatgaataaaaacactttttttgtaggctttatgctgtttgctatcttttttggtgcagggaacttaatttttcctcccaagttgggatttgatagcggatctgaatttattccttctattttaggctttgtattaacaggggttggcttaccgctattgggcatcgttgttagtgcattttataatgggggatacaaagaggcacttaaacaaattcatcctgcattttcattaatttttttaattgcgatttatttatctatcggccctttttttgccggaccaagaaccggtgcaacagcttacgaatttgtgattctaccttttatgggggaagcaacatcaatttctaaactggtattctttgcggtctatttttcattgactttatggctaagtttaaatccgacgaaattagtcgatcgtatcggctctattttaacgcctattttattggtagcgattatcgcattagttatccgttctgtttttttattaagcggacatgatattccaagtgtaacggtgaatacatcaggtagcttttttaatggcgtgattgagggctactttactatggatgccctagcatccgttgctttttctgtggttgtgttaaatgctatacgaaataaaaccgacctaagtgtttcattaaaacagcaaacaatttttgctgcatttattgctgccattgccttgggtttaatttatgtagcattaggatggattggtaacaatatttcaattaatgcggatgtattagctgatttgcaagcgaaaaaacaagaccttggtacttacattctaaacgatgtaactacattagcttttggtgagttaggtcgtacgttgttaggaattatcgtttctcttgcttgtttaacaactgcggtaggattagcggttgctgtgagcgaatattttaatgagatttatccgaagatttcttacaaaacctatgttgttttattttgtttagtgagttttgtaattgcaaatttaggcttaaaagaagttattagtttatcattacctgtattgctaatcctttatcctattgcaatgacagtgattttgttgctttttgttaatattattttcccgacgccaattttagctcatcgcttatctttaggattggtgactgtcgtgtctgttttatcggtatttggggttggaaaaattgagtttatcgagcaacttccactaaaaccttactctatggaatggctaccttttgcattggttggatttattttaggatgttttttacacatattcttcagtaaagaaaaatcagtgttaaaaagataagatataaaaatgagggcatattcaatgcccttattttctagtagtaagagtgttcaccccgctggtgttcagttacgtcttttacacctgtcaattcatcggcaaacattgctaataattgtttttcaatgccgtcttttagggtgacatctaccattgaacagccattacaccccccgccaaattgtaaaatagccttgccatctttggtaatttcaatcaaggtaatatgcccgccatgtcctgccaattgaggattgatttgcgtttggatagcatattccacacgttcaatcaatggtgcatcatcagctactttacgcattttagcattaggtgcttttaaggttaattgagaccccatttcttcagttatataatcaatttcagcatcttctaaaaaagggaaactgacttcatctatgaaagcagaaaactcactgtattttatttcatgatctgttgtttctacggcatttttagggcaataagacacaccgcattctgcattaggagagcctggattaacgacaaaaattcggatatttgtaccttcttcttgttgatctaaaagacgacgaaaatgtgcttgtgcagcctctgaaatggtaatttgcataaattaatattcctagcaatacttgagtaaaattatcaggaatgatactcctagaccgctcttttttccagtaatattacttagtttttatgttaagtttttgccagtccccatacatgaataacgttaattcctgcttgttttaatagttttgctatttcatttaatgttgagcctgttgtaataacatcatcaattaaagcgatggaatgatattgttttgctcgcttaatattcacgctaaaagcgttgtgtaaattagatcgtcttgctttttcatttagtcctcgttgcatttttgtgtatttttggcggacaaccagtttattatccagtggaatcgaaagttggcgtgaaagttgtttagcaattaagtacgcttgattataccccctgtaccattgacgaaaatgatgtaacggaacaggaatgatgacttcaggcaaactgaataaatactctcttcttgcatcgtaaattgctaacaacattaactgtgccaaagtgcggtctaaataatagcgattttgaaatttgaattgatgaataagtgtggataaaggtggttggtagcgtccaatgactaccatttgttgccaattcggtggttgttttgcacaattaccgcaaaacatctgccctctaaaggcttgattttttgataaaacagcaccacaacgtccacaataatttaagcgagaaatttgcttatcacattgataacacaaataacggtgtgcaaaatttaacggtttttgacaatggacacagctaaaattaaaccagttcacttaagttataacctccagagtggaaaaaagtgcagtattccattcaggaaaatatagatcaaaagattagggataatttctcgatcttaatcacaaaaatgctagaattagccaagctaaactaatcattttatgaaggaaaatttatgtctttaactgactatcgtgaaaaaattagcatggtattttttgatattgacgaaaccttattttcaaaagaaaaagatcatttaccggcaagcacttattttgcattaaaatctttgcgtgaaaaaggtgttttggtaggtattgcgacagggcgtgcacgctgtacttttcctgccaaaatcaatcaaatgattgatgaattagggattgatatttttgttactgccaatgggcaacatgttgagtatcaggggcggacattagctcgttatgcaattgacaaaaataaattgtacaaactggttgagttttttgatcaatatggcattgattatgttcaagtagcgaacaccgagattaaaatttccagcctcaatccaatactcactgattcttttaatccaattagtacgaattatcaagtagatcctcgttattttgaacggcatgatgtattacaaattttgtcattctatgaggataaaagctacgatgaattaattgctcaatctaatattttagaagggttaaaaacagtgcgttggcatcctaattcagtggatatatttgataaagacggttcaaaagcacggggaatccaagttgttgttgagcatttagggttgaatatggaaaatgtgatggcatttggtgatgggcttaatgacatagaaatgctaagtgcggtcggtgttggcgttgctatgggaaatggtcatgaattgttaaaacaacaagcgaattatgttactgatcatattgaagaaaatggcatttataattttttacataaagttggtttggtgtaattttaacaaggttaaataacttataggtcgctttttattttctcggcatcattatcctcagtaagaattcaccgcacttttctattagctatgataaacttattgcccttttaggttgatgatgagtgtttatgaagaaaattttattcattgtattgttgtttttgtgtggtgcaggcggtagcgttttttgggcatattggcaaataactgactttgtaaaacaacctgttaaagtcaaagaagagcaacttttaactgttgtgcgaggaacgaccggcaataaattggcaatattattagaaaatgaagggttaatcgaaaatgggaaatggttgccttggctgcttaaattaaaacccgaattgaataaaattaaagccggtacttattccctcgttaatgtagaaaatattcaagatcttcttgatgtacttaatcagggcaaagaggtgcaatttaatttgcaattgattgaagggcaacgttttaaaacttggcgtaaaattttagaaaatgcaccgcacttgcggcaaacattacaaggaaaatcggagaaagagatttttactttgctggagttaccggcttattcaaaagctgtttatgaatggaaaacgattgatggttggttatatccggatacttatagttacacgcctaactctagcgatttggcactgttaaaacgtgcggcttcccgtaccataaaagcgttggagcgagcttggcaacaaagaaatgtaaatttgccattgaaaaatccctatgaaatgttaattcttgcttctattgtggaaaaggaaacagcattgactgaggagagagcgaaagtagcgggtgtttttgtgaatcgtttaaataagcaaatgaaattacaaacagatccaacggtgatctatggtatgggtgatgattataaaggtaatattcggaaaaaagatttattgacaccaaccccttataatacctatgtgattgatggtttaccgccgacgccgattgctatggtaagcgaggaaagtttacaggctgttgctaaaccggaacagcatgattatttatattttgtcgcagatggaagcggtggacacaagtttagtaaaacattggcagaacataaccgtgctgtgcaagaatatttgcgttggtaccgttctcaatcaaaatagtgaaataaaatgaaaacaggaaagtttattgttattgaaggcttagaaggtgcaggtaaaagtagtacacatcaagttgtggtaaatacattgaaggagtttggtattcatgaagttgtttttactcgggagcctggcggaacgcctttagcggaaaaattacgttatcttattaaacatgaagccgaggaacttgtcacggctaaagcagaattgctcatgttgtatgctgctcgagttcagctcgtagagaatgttataaagccggctttagcaagaggcaaatgggtagtgggagatcgtcatgatttatcttcacaggcttatcaaggaggcggtcgaggtttggatcggcatttgatgacaacgttaaaaaatgctgtgttgggcgattttaagcccgattttacgttgtatcttgatattgaaccagaaattggtttagcaagagcaaaaggaagaggggaattagatcgtattgaacaacaaaatttagatttttttcaccgtactcgagcaaggtatttacagttagtgcaacaagatcctaatgcagtgctaattaatgcggggcaacctattgagcttgtgcagcaagatattcgtaaagctgtgcaaaaatttattgaagaaaatgtgtaatttatatccttggttacaaccttattatcaacgaattatccaaccttttttacaagagaaagggcatcatgctttgttatttaaagctgaacaaggaataggtatcgagcaattgattgaaaatatcgcaggttggttaatgtgccggcaaaaagatgccctacaatcttgccgacaatgccaaagttgtgcattattcagagcaggaaatcatcctgatttttatcgacttgaatctcttgacaataaggatattggtgtcgagcaagtgcgagaaatgaatgaaaaagttagtcagtttgcaaaacaaggcggaaataaagttgtgtttattagtcaagctgaacgtttaactgaaagtgcggcgaatgcgttactaaaaacgttggaagagcctagaccgcatacttattttttattacaaatggacttttcggctgggttgttagcgacaatttatagtcgttgtcaagcttgggttattaatacgccaacagagcaacaaggtcttgtatggttgcaacagcagcgtcaggaaaaaatcgcagatttacaaaccgcactttgtattaattataatcgtccattgctggcattggattgtttggaaaaggggttattagaacaacgaacgacatttttacgtcagttttggttgttttatattcgacgttctcccttggagttattaccgcactttacgaaagaaaatgttttattacaactggactggatgagtgcatttttacatgatgcactcaaagaaaaattaggtgttcggcaaggttggatcagccaagatttagctcgtggcattttgcaatttaatgaaaagcaaaatgtggaagagttgttaaaagcaattcaaattatccaaaaaatgcgtttgaatctaacgcaaatcaatggggttaaccaagagttaattttattagagggattgactcgtttggtaaccgatgtatttgaaaggaaagaataggaaaagaaatgtttattgtggatagtcattgtcatcttgatgccttggattatgaaaacttacatacagatattgccgatgtggtggataaagcaaaacagcgtgatgttaaacatttattggcagtaggggtaactttgaagcgttttgagcaggcttatgcacaattagccttatttaaggaagtttccctcgcttgtggtgttcatcctttggatttggcggaagaaccttttgattatcagcgtttattgaggttggcacaagatgaaaaggtagttgcgataggcgaaaccggattggattattattacagcattgaaaataaatctttgcagcaatctgtttttgcacaacaaatagagattgcaaatcaactgagtaagcccgtgattgtacacactcgatccgcccgagacgataccattgccattttgcgagaaaataatgcacaaaagtgcggtggtgttttacattgttttacagaaaattggggaatggcaaaacaagcacttgatttagggttttatatttcgatttcaggtattattacctttaaaaatgcacaagagttacgtgatgtagtacgtcaagtaccattagagcgtttgttagtggaaactgatagcccttatttagcaccagtcccgtatcgaggtaaacaaaatcagccggcttatacacgtgaagtttgtgaatatgttgcaacattgaagggattatcagcggaagactttgcacaaattactacgcaaaattttgagcgtttatttaagattaatgtacaataaagcaacaatttacagggggagttatttatgagaaaaatatttaaaaaggtagtgttggggttactattcttattccatgtttttttattttctgtggtgcattatgttacgccacattatgatgttaccaaagttaccggtgtagaagtaaagagagttgataaagatggacctattactaaagctaatccggctgacggtccgactcgtgatgtgtattatatttacacgcaaaaaccgaatgaggaaaacgtgatggtgtatcgtaatgaagatacacgttggagttttccattttattttaaattcggttccgccgatttacaggcaaaagcccaaagtttttcagtggatcataagttagtggaaattaagtattatggttggcgtttggttatgtttgatgaattccgtaatgcagtgtcagtcaaagaggtgagtgcggatacagaagcttctcattccattttagcttatgttttttacgcatttttattgattacgttatttttctctatccaatttgtgcgtggttggtttgatagtgaagactaactttttggtttgatatgcttctattctcatcagaagctactttgttaggcattgaatattatgagtttattacaggcaatattagtcattattggcttaattattattagtgcggtcgtttcttccgctgaaatttcgttagccggttcacgtaaattgaaattgcaaatgttagcgaatgagggtgataaacgagctgtgcaagtattaaaattacaagagcaaccgggacgttttatcacagttgtccaaattggactaaacatggtggcaatttttggagggattgtgggtgaaagtgccattcgcccttttttacaggagattttaagtgcttatacgcaatctttttgggtagaaagtgcagcttcttggctggcttttattattgtcactgtttcttttgttctcttcgctgatttaatgcccaaacgtttagcgatgacaagtccggaaaaagtagcattgtcaacagtaggaataatgtctttttgcattgttatttttaaaccagtggtcttaatttttgatactattgcgaacggaatttttcgcttattgggaatttctaccatgcgggaagagagtatgacgccagcggatattgttgcaattgtagatgccggtgctgaagcaggcgtattaaaagcacaagagcattatctgattgaaaatatttttgaaatgcaagagcgtacagttacgtcaactatgacgactcgtgaaaatattgtgtttttagaccgctcttttgagcgtgagcaagtcatcaccacaattaaaaataatccacattcaaaactacttatttgtgatcacggtttagataaaattttgggttatgtggaaagtcataatttattaactttatatttgcaagaacaacaagtttctttaaccgagcctagaattttacgaaaggcattatttattcctgatacgctttccttatatgaagtattggagttgttcaagtcttccggtgaagattttgctgttattgtaaatgaatatgctcttgttgtggggattgtaactttaaatgatgtaatgagtattgtaatgggcgaattagtttctaatgaggaagaacaaattgttcgccgtgatgaaacatcttggttgattgatggtgcaactcccttagaggatgtagcacgggcattggaaattaatgagtttccggatgaagaaaattacgaaaccatagggggatttatgatgtatatgctacgtaaaattccgaaaaaaacagatttcgtattatatgatagatataaatttgagattattgataccgagaattttaagattgatcagttgatggtatccttaagaaaggatatttagacaagattcaaaagagagtaaaccacatcttcgctttttttagatattatcagtcaaatgcaattaatgggatttttcttataaaaatagaaggttatgtaaaagagataaaaagcaatccgaagattgcttttttgttccgcttattgagcaagtgcacgttttaattttaggatagtcgccttccctttatcttcatcgacttgtttaagattggctccgccaacaaatgcaccgggtttaatatattggcgaataaaataattttttccgccatctgtcgtaatatcaaggtgattatcactaaactctgattctgttgagagcctatgattacccgggattacacgcttgtaaaaatatgttttgggtgcggattcaccaataagtttgccatcgatataaagattcttcttcaacgcagctccaaatattgaatcacgataaatataaatccctgattcatcctttgatggaagcaaaaactgtttagccaaagcatcattttcaggggtatccatcaccgttctggcacaaccggtaagtcccaaagtgattgccagcaagagagttgaaaaaaatttcatttgatgtctagcccatacgacttagaagtaataacttgcactcaatgacaagctttgtggcttgaagcgaatatcgccttctatattgcggaggaagactttttgatattcaacacccacatcaaatttatccgttacggcatattttacccctacagcagcaccaataccgacaacagagtttccttttatggtgcaactatcacaaattttattggcattaagatcataaaaatgactatttaaactcactttaagatacggcatgaaattgttactaatgcgatagccttgaagatagccaacactgaaagaaaatttttctttggatagtagttcgttattagaagtgatttttgaaccgccggtacgtaattttacttctgcctgacctacaaaattactgtcaccaaaattaaagccgtaaccaccgaataaaccaaagcctatttttcctgattttttttgggcttcgttttttgctgcgttataaagcgtacccttataaccatgttttgaatgatgaacttctccacccataaaaaagccagtgaaagtatcttgtgccattgcaccacttgccatgcaagataataataccgttgcagcgatagatatttttttcataaataaaccctcttaataaagattaagttaaatttgaaactattttattgttaagagaaaactaagtcctaagatcttaattttcaaagatatattctacataggtatattatgagtaccatagacaaataagacattattagtctaataagtagaaaaacagtctaaaaagaggaaatgaaaaaattatctacatattgtctgaaagtatttaaacgaaaagagcggtgtaaattttaaaaattcgtaccgctctttttctatatcagttacttaaaaagaatattcatatttctgcgatgttgtagctggtattttctattaagaattataatttaggttcaccaattggtaatatggttttaccaaaactttcattgataatatcagcggcagcgagatagaacgctaaaagtgcggtcaataaaccaaagtttccacctagttggctaaagttgtgattaccggtaaaatcgcctgtagcaagtaagtagaaggtgatggttaacgctaagaaaatagcctgtaatgcacgagtttttgctaatgtgccgataaacatcatcaatgtgaatgttccccacgccgctaagtaccagcctacaaaagatgatgtgacaccttgtgagaaaaatactttgaataaggcaaaactccaccaaaaggcaccatagctggtaaacgcagtaaaaccgaaagtattaccttttttgtattcaaacataccggcgatcatttgggctgtaccaccgaacgcaaatcccatggctaatactaaacctaaattttcaccgctgaacataccgttattgattaaacttaataaccaagttgttaatgcaaatccacataagcccaatggtgccggattcgctaagttatcttttgttgtcgacattatattttgcccttaaattaatttgataaataaaaaaggcgttattatctatgattttattgaataaataaagattggtatgaaaaacgctaggataagaacaatgaaattgggaaagtagctagaaaattaattattttttgtttttcgctattgttatttagatgtaaaatacgttcagctgagttttaagggtaaaatacgatgagcgtttagtcgccacttagtctgcaaaatgcgaaatgttaaatcacaagcatgtgagtttaaggattggcaagaaatgttatcatcaagttaaacgtcagtttctcgtttttacgcctaaagttgctggagcacatcattggacacaggtaagctcgacattagaggggagttagaataaaacggatttcgttttctaacagaagaaagtaattgtttttaaaaggaaaatttgttgaatactcaatctaagcaaaacgctagttttgtttttattttaaccttaggcattttatcaatgttacctccacttggagtggatatgtatttgccggcatttttaaatattgcacaagatttgaaagtaagcccagagcaagtgcaacatactttgactttttttacttatggtttggcagcggggcaattattttggggacctgtgggagatagttacggacgtaaatcggttattttattaggtgtgattgttgcgactattacagcatttattttaaccggtattaataatattcaaaatttcaccgcacttcgttttattcaaggcttttttggtgcggcacctgtggttttatccggtgcgctattacgagatttgtttagcaaaaatgagctttctcgaatgctatcgatgattactttagtgtttatgattgctccattactcgctccaattattggcggtaatttgatgcgttttttccattggcatgcaattttttatgttatctcggcaatgggaatgctaagtgcggtattggttttttatgttattccggaaactcataaaaaagaaaatcgcattcctctcagattgaatattatcgcacgtaactttttttctctgtggaaacagaaagaagtactgggttatatgtttatgtctgcttttggttttggcgggttatttgcttttgtgacagcaggttcaatcgtttatatcggactttatggtatagccgttgaaaattttggttatttctttatgttaaatattggggttatgattattgcctcctttatgaatgggcgattggtgtttaaagtgggtgctgaacgtatgctacaggttggtttgatggtgcaatttatcgccggtctttggttagcattcgttgcgttttttgatttaggtttttggtctatggcaattggtgttgctttttttgtagggcaaaatccattaatcagttcgaatgccatgacatctattttagagaaatttccaactatggcaggaacatcgaattctatggttggaagtgtgcgtttcggtatgggggcaatagtggggacaattgttgctttatttgaaatgaaaacggcagcaccaatgcttttaacaatgacgatttgttctttgcttgcggtaagttgctattattttttaacttaccgtcatttaaaaaaataaaggaagatcatggcattgcaaccttgccctgagtgtcggcgtaaaatcagtgagtgtgcgataagttgtccacattgcggtttttcgttacaagaagaaaatttgatgctatatcgtgaaaaactaaaaaaacattgtcagtataatcaggagattaaccgagcaagcattaaaatccatttattttggttggcggtgttttctatagtgattgggatagtcggttggttaagtaattagtcgttaaaagatattcaagcccctgtaataaggggcttttttgtatggtttaactttttgttttcattgctggaaataaaatcacatcacgaattgagttagcgttggcaaataacatcgctagacgatcaattcctaaaccctcaccagccgttggtggcaatccatgctcaagtgcggtaacaaaatcttcatctttaaacatagcttcatcgtcaccagcttcttttgctgcaacctgtgcatcaaaacgctcattttgatcttctgcatcatttaattctgagaaaccgttaccgatctcacgtcctccgataaataattcaaagcggtctgttacgtcaggattttcatcattgcggcgtgctaaaggggagatttctgccggatgagccattaagaaagttggttgaattaaatgatgttcagcaacttcttcaaaaattgcattgactaagctacctagcccccaggatttttgtacttcgatacccaatttttgtgctactgcaacagcacgatcgaaatcgtataaatcttctttcacaataccttgctcggcaccgtattttaagattgcctcgtgcatggtaatacgttcaaacggtttgccgaaatcgaattttaaatcgccgtaaggaacaatagtcgtacctaaaatatccagtgctaatttgcgtaaaagttcttctgtattgtccattaaatcgtggtaatccgcataggcttggtagtattccaacattgtaaattcagggttatggcgaacagaaacaccttcattgcggaagttacgatttaactcgaatacacgttcaaaaccgccaactaccaaacgttttaaataaagttcaggtgcaatacgtaaatacatatccacatctaacgcattgtgatgagtaataaatggacgtgcagatgcaccgccaggaataatttgtaacataggggtttctacttccataaatcccttggaaatgaaatattcacgaatgcctgcgattactttagatcgaataataaaagtgcggcgtgaatcttcattagcaattaaatctaagtagcgttgacggtaacgagtttcttgatcgctcagtccatgaaatttattaggaagcgggcgtaatgctttagttaataagtgaacttccgttgcacgtattgtcaactcattggttttagttttaaataaagtaccttttacaccaacaatatcccctaaatcccaattgcccacatcatcagtataaacaccttcagctaggttatcacgagcaacataaagttgaatttttccgctcatgtcttgcaatgtgataaaggttgctttacccatgacacgacgagtcataatacgccccgccacttttacttcaattccctgtgtttttaagctctcactttcaatttcatcatattgtgtatgtaagtcctgtgctaaagcattgcgacggaatgtatttggaaaggcgttgccttttgctcttaacgcagctaatttttcacgacgaaccaacatttcgccattgagatccaattcttgaattatttctgtcattatgtactcctcttggaaagtcacttttagaataaatttgtcatttgaataaaatattgtggtttttgaccgctctttatagtccggcttttaagctggcttcaataaaacgatccaaatcgccgtccaatacagcttgagtattgcgattttcaacacctgttcgcaaatctttaatacgggaatcatccagcacataggagcggatttgactaccccagccgatatcagatttattgtcttccatggcttgtttatcagcattttttttcatcatttccatttcgtacagttttgcttttagctgcttcatggcttgatctttattctgatgttgagatcgtccattttggcattgcaccacaataccgctaggaatatgagtaatacgcaccgcactttctgttttattaacgtgttgtccgccggcacctgatgcacgataaacatcaatacgtaaatctgcaggattgatttctatttcaatatcatcatcaatttcaggataaacgaaggcagcggcgaaagaagtatggcgacgattattggaatcaaatggacttttacgtactaatcgatgaatacctgtttctgttcttaaccaaccgaaagcatattcgcctgcaatacgaatagtggcagatttcaagcctgcaacatcgccactggaaacttcaactagttcggttttaaagcccttgctttctgcccaacgtaaatacatacgcaatagcatttctgtccaatcctgagcttctgttccgccggagcctgcttgtaggtcaacataacaatcacagttatcatgttgtccgctgaacatacggcggaactcaagggtggcaagttttttttccaattcttccgcttctgcgacagcttcattaaacgttgtttcatcttccgcttctacagaaagttccagtaagccatcgacatcttccaaaccttgctcaagggtttttattgtattaacaacaagctctaaattagcccgctctttgcctagcgattgagctttttccggttcattccaaatatccggttgttcaagttctgcatttacttcttctaaacgttcaacttttgtatcaaagtcaaagataccccctaagcatatttgtacgctcagtgagatcgattaatttattttttatcggattaatttcaaacatagcttttcccaatgataacaagtgctgaattataagctattttgctgatgttgggtagttgcagattagattgttcaaaggatttatgttagaatttcgtccgttttttactgaaaattaggaacttaaaatgaaaaaatttttaatggtaagtttagccatgttgatgtcaacttttgtaaaggcagataataatgtcacaattcgcaaaaatttacaaaaattaggtatgactgatgtagaaattatggagtctcccattaaaaatataaagagtgttttgacccgtgaaggtactctgtatgtttcggaagatggtaaatatgttttacatggtgctttgtatgaaattactgacaaaggtattgtgaatttaacgacaaaatctttattggtaaaactgaataacttaaaaaatgagatgatagtttatccagcgaagaaggaaaaatatgttattaccgtattcatggacattacttgtcattattgtcatttattacatcaaaaaattaaagaatataatgagttaggtattactgttcgttatttagcttttccacgtgccggtctaaatagcaatacagcaaaacaaatggaggcgatttggacatctcgagatcctgttttcgctttagatgaagcagaaaagggcaatttaccgaaagagctgaaaattccaaatatgattcagaaacattatgagcttggtattcaatttggagttagtggcacaccaagtattataactgaaagcggcgaagtgattggcggttatgtagagcctaaaaaattgttgcaagtattagaagatattcgtgaataagtttattaaacgacgtgatgttgcgatagatgttcaagtttgtgaacatcctttattggaccgaatttaccgtgcacgtcaaattaaaaatcctcaacaattagaccgcactttgaaatctatgttggcacctgatttgctacatggtattggaagtgcggtggatttattggtaacagcgagagaaaaacaacaaaagattgttattgtcggtgattttgatgttgacggagcaaccagcacagcactcattgttttggctcttcgtcaacttgggttcacagatgtagattatttagtacctaatcgctttgagcaaggttacggtttaagcgtggaagtagcgaaattagcattagaaaaaaatgttgagttattgattacagtagataatggggtatcttcttttgatggtgttgtgtttttaaaaaatgcgggagtgcaagtgttgattacagatcaccacttaccgccggaaatattgcctccagcccatgctattgttaatccaaatcttacacaatgtaattttccttcaaaatttcttgctggtgtcggtgtcgctttttatgtcatgctggcattgcgtgcaaaattacgtgatttagggatttttactacgcaaacccaaccgaattttacagagttattagatttagttgcccttggtacaatttccgatgtagtaccgcttgatcaaaataatcgtattttagcttatcaaggtttagccagaattcgagctgagcgttgtcgtcccggtattcgtgctttggcggaaattgcaaatcgtaatatgagtcgattgaccgcttctgatttaggcttttctattggtccaagattgaatgctgccgggcgtttggacaatatgtctgttggtgtggagttattattggccgatgatatgcaacatgctcgtcaattagcttttgaattagatagtttgaatcaggctcgtaaagaaattgagcaaggtatgaaacaggaagcgttagaaatttgtcggaatttgaccgcactttctaagcaattaccgctgggcatcgtactatatcaggttgattggcatcaaggtgtacttggtattttggcttctcgaattaaagataaatttcatcgaccgaccattgcgtttgctcaggatcaagtcggaattttaaaaggttcagcacgatctattgaaggtttacatatgcgtgatgtgttagagcgtattcattctcgctatccggatatgattttaaaatttggtggtcatgcgatggctgctggtttgagtattcgtgaggaattgtttacacaatttcaacaagcctttattcaaactgtgactgaatggttaaaagaagaacaattacaaggtattatttggactgatggtcaattagcacccgcgtttttaaatttggagacagcggaattactgcgtcaagcaggtccttgggggcaaggttttccagagccgtgttttgatggtgaatttacaattttacgccagagtattgtgggtgaaaaacatttaaaaatgcttgttgagcctaaacaaggaggtccgctgttggatgctattgcatttaatattgataaggattactaccctgatttttcgataaaacatgcaagaatagcttataaattagatagtaatgagtttcgtggaaatcgtcatgttcagttgttggtagattatattgaacctttagatcattaaatttatttttcggcactggtacataataatgttttagggacaataaaaatgacagaagaatatggcgtatttacttatccctatgtcattattaatggtaaatatgttttgacagcaagtactttatataacgatgattatagtgttgcagtgcttgattttttaattcatcaaattcaagtggagagcaggaaatgaaagtaggtattgttggtgcgatggcacaagaagttgagattttagcgagtttaattgagaataaaaacgtagttcatattgccggctgtacaatttatcaaggaaacattcaagataaggaggttgccttattacaatccggtattggaaaagttgcagcagcaatgggaactacactattattgcaaatgtttaagcctgatattgttattaatacaggatctgccggcggcgtatcctccggattaaaagtgggtgatgttgttgtgtctactcaaactgtttatcatgatgctgatgtgacagcctttggctatgctaaaggtcaactgcctgcttgtcctccagcttttatttctgatccgaaactgaccgcacttgttgcaaatgttgcaaagcaacaaggcattaatctgacttccggtttaatttgctccggtgacagttttattaatagtgcagaaaaattagcttggataaaagcaaattttccagaagttgttgctattgaaatggaggcaacagctattgctcaggtatgtcataaattcaatattccgtttgttgtcatacgggcgatttctgatgtcggagacggtgaagcaagcatgtcttttgaagagtttttgcctttagcggctaaacagtcttcctctatggttctaaagatattacaaagtttgtagggaattgattaattataaatatcaacttgataaataaagaaaaaatctccaaattgatctgcaccccaaaagttggactaaacagccaactgattaaggtgcagattttttatgactaaatataaccaatctttcaaacaacaagtcatcaaattttatcttcaaaacgggaaaaatcgctcgcttactcgtcagcattttcagctggagaaaagtacattacgtcattagattaaccaatatcgtcactatgggttcaaaaggttagctgttttaggtaaacagcaaatgttgtaaaggtactgcgagagcaatttccgctttaaatcctgttgccacttatcgacttaaaacgcagtactttcttttatcaccttgcagataaagtggataaaaatgcggaaattaggcagaaagaggccgagatttatcacgaaaacaacggtaactatggctatcgtcgtatcacgctgatattgagaaaaatctgaacaatcaaccataaaaaagtccacgcaacaaaatgctacttcggcaagcgtttgacacgcttggcgaacttaagcaaactattcatgaatacattcattactacaacaatgagcgtattcaagtgaaattaaaaggaccaagtcctgcagaatacagaactcagtcctcaagttaacgcagtctaacttttttgggtcagatcaattcggagattttttgttttggattattttgagcttggaatgctgaaacgcttgttgaaacgttctacacgaccgccggtatcaacaacacgttgtttaccagtatagaaaggatggcagttgctacatacgtccaagttcaaatttttacccactgttgaacgagttttaattacgttaccgcaagaacacgtcgcagtaatttctttatattcagggtgaataccttgtttcatagaaaacctcttaaaaatcactccgctctccaaaaccgaatttggcaccgagtgctgttaatattacgccatctaaaggcaatttagtaaggtggcagattataccgaaaaaatgggctttttcaagttatctgtataaaaaaccgcactttatccttgcatgttaaagtgcggtataatttgcaacaattttttacattgctgtccaaagtaaaatggcaagcaactgaggcgacataatacgcaggaacatagaaagcggataaacagtagcgtaagataatgcagctataccgctatcttctttaattgcattggcaaaagccagtgcgggaggatcagtcattgaacctgcaagcaaaccgcataagctgagatagtttaatttcatgtataagcgagcaataatgccggtgatcattaatggaataaaggtaatgaacataccatatcccatccattcaagtccttgaccattaaccagtgtgtcaacaaatccgcctccggattttagtccaacaacagctaggaataaaacgataccaatttcacgtagtgctaagtttgcactgggcggcataaaccaatagagtttaccgacactaccaatacgagcaaggattagtgcgataactaatggacctccggctaaacctaattttaatgctacagggaatcctggaatgtagaatggaattgagcctaatagcacgcctaatccaattccgataaataccggtaacatttgaacttgttgtagtttttgttgtgcattgccaataattgaggttgcattaccaattgtatcggatcgccctacaatatgtagcacatcgccaaattgtaatgcggtgttggctgttggaactaactctacgccggcacgatttaaacgtgaaatcacaacgccatattttttatgaattcctaagtgttttatgcgtttaccaagcactttttcattggtaacaacaatacgttcagaacgaagatcgcccgctaaatgagtcataggcatatcaatttcctcacctatcaccaatttcatttttttcaacgcattgatttcaccaactaaatgtaatacgtcatcaattgctatgatggtatctgcacttggtacactaatattttcttgacgttttaaacgagaacaaaccacatctttattgtcaaaaccgggaatatcaattaggcgtagaccgcttagatttggattagttacccgaatatttattgtggttaaactttctttatcctgtccgttggccttttggaattgtttatcctcttcttcaactttaattttaaaaaataagcgaattaaccacatactgagtaaaataccgcaaattccgaaaggataagccatagcatatgccatacccatagtactgttagcattttctactcccagttcagtgagaatttgttgaccggctcctaaggatggcgtatttgttaccgcacctgagtagattccgagaataacatcaagatcaacattaacgactttgtacagaacaaaaacacttactgcaccgagaacaacaattaatgttgctaagccgttcagttttaaaccggcagagagtagagaagcgaaaaatcccggaccgacttgaataccaatagtgtaaacaaaaagaattaaaccaaattcttggataaagtgtagagtgtgtgcatctaatttcacaccattttggttcataaaatgagcgacaataatccctccaaataaaactcccccgatgcctaaaccgacaccacgtattttccaatgccctatccataaaccaacaacggcaacaagggctaagatacaaattgtgatagcaatatcactcataccaacctcttttaattttaaatataaaaaataactacacgaattatatcaagctcaattcaaagaaacgacaaaaatctaaaaaatgtaggatttatcacatttttcttgattaagttatggtttttattaacaatatttgaaaaaaattaaatttcatttaatccctttattataagaggcgttgagaatacaaaatgaattggacggaagaactttttacatcgttactttggatagtaaaaagcttatttatagcaagcttggttttctctttaattttatattttttgataaaaatgacccgatggggacatcaattttggctattagcgaaaagttatttatcaccacgtcatagccttatgcctttgtgttatttttgggtaatcgttttttttgacttattatccgtgcgtttggacattttattttccagttggtataagtccatgtatgatgccttacaagaaatgaacgtagttggattctggcagcaaatggttgttttttcccttttggctatggttcatatatttaatgttttgcttacttactatatttctcagggcttcaaaattaaatggagaacttggcttaataatgaaatgttagataaatggtctgaaaatcaggcttactataaaacgcagtgccttgcccatcaattagacaatccggatcaacgtattcaacaagatattgatgcctatgtttccaattcattaaactttgctacaggtgttatttcttccacggtttctttagctgcatttaccgtgattttatggaatttgtcaggtccgatggtaattatgggctatgaaattccacatatgatggtattcttggtttttatttatgtattagtgagtagtgtaattgcttttagaattgggcgaccattgattcaattgaattttgttaatgagcgtttaaatgcaaactatcgttattcattaattcgtttaaaagaatacgcagaaagcatagctttttatcgaggggaaaatatagaaaaatcgatgctattacgccaatttgaaaaagtaattggtaatttgtggcaaataatccaccgcactttgaaattatccggcttcaatttagtggtttcacaggcatcagtcatttttccatttattattcaggcagcccgttatttttccggacagattaaattaggtgatttaattcagacgtcacaggcttttagcaaggttcagtcagcactatcgttttatcgaaattcctatgatgattttgccgcctatagagcggtattggatcgtctaacaggtttccatagtgctattgaagcaactaagcagccatcaaaaacacaaatagaacctcatatgtcagcggttatttttgataacttaaatattaatacgccggaaggaaatgcactaattaagagactggacttaacgattgagcaaggtttttctttgcttattcaaggtaaatcaggtgtagggaaaacgactttattacgtacggtagcaggattatggccatattcggaagggcggattttttgtccacaacaaacattgtttttagcacaaaaaacctatttaccacaggggtgcttaattgatgctctttattatcctgaaccggttccggctgacgttgaagcagataatatcagtaacattttgcaaaaagtgcatttgtctcatctggttgacaaattggatgtagaaaatgattggacgagagtgttgtctttaggggagcaacaacgtgtagcttgtgcgagagtgttgttacataagcctaaagttgtttttttggatgaggctacatcaagtatggatgaagggcttgaagatgcgatgtatcgtttactgctaactgaattacccggtacaactttgattagcgtaggacatcgttcaactttgcataaatatcatcaattgcacttgtatattaatactgataaaagttgggaaataacgaaacatgcaacagtattttagcatagaatatacttgttaatttgctagatgaaatttatccatcgaccttagggcggtggatttttttacgttctaaatttgatatagatcaaataaactttatttttatttgcaaattattctcaataaatttgagattttttactagaaaaattaataattaagcaggtttttcttacaaaatttatgcaaataacacacaatatatagtggttgagtttttaaaagtaacaatatatagtgatttgacttttcttaaacgcaacatataggtttatgtaaaaatgggttcattcttcgttattaaacgtgatggttcacgtgcagaatttgaaatacaaagaattattaatgctattaaaaaagctgcaagtgcggtcaatatccaagatgaaatgttctgtcatcaaattggacaactggtctgtgataatatttttgctcattaccaaaaagaaattgatattagccacatccaggagattgttgaaaatcatctgatggctagcaagtatccacaagttgcacgagcttatattgaatatcgtcatgagcgtgatttagctagagagaaacgtagtaatttgactaaagaaatcgaaggattaattgggcaaagtaatgtggaattgttaaatgagaatgccaataaagattcgaaagtcattccaactcagcgtgatttattggcgggtattgtcgctaaacattatgctaaacgttatattctgccaaaagatgtcgttgattcccatgaaaaaggcgaaattcattatcatgatttagattatgcaccattctttcctatgtttaactgcatgttggtcgatttaaaaggtatgctgacgaaaggatttaaaatggggaatgcggacattgagccgccaaaatctattggtactgcgactgcggttaccgcacaaattatcgctcaagtggcaagtcatatttatggtggaactactattaatcgtattgatgaagtacttgcaccttacgtgcaactcagctatgaaaaacacttgaaaacagctgcactttggcaaattccagatcccaaagcttatgccgacagtttaattcaaaaagaatgttttgatgcttttcaatcgttggaatatgaagtcaacactctgcatactgccaatggacaaacgccatttgttacttttgggtttggtttggggatcagttggcaagagcggttgattcagaaagctattttgcaaaaccgaattcgtggattggggaaaaatcataaaacacctgtttttcctaagttggtttttacaattaaaaaaggggtcaatcaaaattcaggagatccgaattatgatattaaacagctcgctttagaatgtgcttcaaaacgcatgtatccggatattctcaattatgatcaagttgtgaaagtaacaggttcatttaaagcaccaatgggatgccgtagttttcttggtgcttatgaagaaaataacgaattggtccatgatggacggaataatttgggtgtagttagcctaaatttgccacgtattgcactggaagcgaaaggcgatgagcagcaattctatacattgcttgaagcaaggttggatcttgctaaaaaagcattgatgacacgtattgcccgtttggaaaatacaaaagcacgagttgcaccaattttatatatggagggagcttgtggtgttcgtttaaaagcagatgataatgtggcacaaatttttaaaaacggtagagcatcaatttcgcttggttatattggtattcatgaaactattaacgccctatttggcggtaaacacatttatgatgatacaaaattgcgtaaaaagggcattgaaattgtcagtttcttgagcgaaaaagttaaacattggaaagcggaaactggctatgcttttagtttatattccacaccgagcgaaaacttgtgtgatcgtttttgtcgtttagataccaaacagtttggtgttgttgatggggtgacggacaaaggttattacacaaatagctatcatttagatgttgagaaaaaagtaaatccttatgataaattggattttgagatgccttaccctcgtttagcgagcggtggatttatttgctatggtgaatatccaaatattcagcataatttaaaagcacttgaagatgtttgggactattcttatgaacgagttccttattatggtactaatacaccgattgatgaatgctatgaatgtggttttacaggagagtttagttgtacaagcaaagggtttacttgccctaagtgcggtaatcatgatagtgaaaaagtctctgtaacccgtcgagtatgcggttatttaggaagcccggatgcacgtccgtttaatgctggaaaacaagaagaggttaaacgccgtgttaaacatttataaaaatcatcgctctttatgaattatctgcaatattatccgattgatgttgtaaacggtgaaggcacaagatgtacgttgtttgtcagtggttgctcccatgcttgcaaagggtgttacaaccaaaagagttggtcatttagggctggagtattatttgatcgagagatggaagatcaaattattcgagatctacaggatagacgcattcgccgacaaggattgagtttaacaggcggtgatcctttacatcctcaaaatattaccgcacttttgccttttgtgcagagagtaaaaaaggaatgtcctgataaagatatttggctatggacaggttatttattagcggagcttgatgaattgcaacggaaaatgttgccttacattgatgtgttaattgatggtaagtttgagcaagaaaaagccgatccaagtttgatttggcgaggatccgcaaatcaagtgatttatcgctttaatatttagcttttatacatattcttaaataagctcattcatacgaatggtgcggtatattcaaattctatattgaatttgcataaccaatttcaacttaggtatttgtaacgatatagaatatatcngcaaattgaatattataaaaaaaccgctcataaagagcggtttttttgcgaaggttttaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttagcttttgtagttatgtacatgagcaactaaatctaatactttatttgagtagccagtttcattatcataccaagaaactaatttaacgaaagtatcagttaatgcaatacctgctgccgcatcgaatacagaagtcaaactacaaccgttgaaatcagtagaaactacagcgtcttcagtataacctaatacacctttcatttcattttcagaagcacgtttgatttctgcacagatttctgcataagttgccggtttttccaagtttacagttaaatcaacgacggaaacgtttggtgtaggaacacggaatgccatacctgttaatttaccattcaatgcagggataactttaccaacagcttttgccgcacctgttgaagaagggataatattttgtgccgcaccacgacctccacgccagtcttttgcagaagggccatcaacagttttttgggttgctgttgttgcatgaactgttgtcattaaaccgtctttgataccgaatttgtcattgataactttagctaacggtgctaaacagtttgttgtacaagaagcattagaaacaatgtcttgaccggcatacgcatcaaagtttacgccgttaacaaacattggcgttgcatctttagatggaccggttaaaacaacttttttcgcacctgcggtaatatgtttacgagcagttgcgtcatctaagaataaacctgtcgcttcaacagcaacatcaacaccgagctcattccattttaaattagcagggtcacgctctgatgtaacacgaatcgctttaccattgaccactaagtttccatctttgacttcaactgtaccatcaaaacgaccatgagttgaatcatatttaagcatataagccatatattcaacatcaattagatcgttaataccaactacctcaatgtcatcacgagtttgtgctgcacgaaatacgatacgaccgatacgaccgaaaccattaataccaattttaattgtcataatattttcacctataatattttaagttaaacgaaactcgatgctttacagaagtgcttagtctttctagttttcacgctggggtagattatagcataaattcttctttgattatagtgtctctagagtaaatccggcatatatagattttttatgatccacgtcaaagttgataatgtttgtaccacattgattttttagtgtagtatgtgcggagatttatgtttcatcgttaagcggaaaatgacttttcatatggaaataggaagaatatcatgttaaccaaccaaccaaccaaccaaccaaccaaccaaccaaccaaccaaccaaccaaccaaccaaccaaccaaccaaccaaccaaccaaccaaccaaccaaccaaatgaacgtctattttccatagtaaaggaagtttttccgaaaagtcatagcataaatttttgtcttttagggggaatgacaaataagaattatctccttcatgtggataatgaaaaatatgtattgcgtctgcctggggtaatgacatcaaatttgatttcaaggcactatgaaatgaataatagtatattgatgtctcaggcagaatttaatgttgaaacaatttattttaatgctgataatggtattaaaataacgaagtttttagaaaaaggtatcaattttaatcataataatattcatcaatatgaatatttatctctcatctcaaaagaattatataaattacatcattcagatattcaatttaataatgaatttaatgtatttgaaacttttcaacaatattttgacttattaaaagataagaatggatttttctgctttaataaaaatattcaattgatatacgaattttttcttaaaatttcaaagaataattctttttataacatcaaatgtccttgccataatgatcttgttcctgagaatattttaatgaaaaacaataaattattttttattgattgggaatattcaggaatgaatgctccgttattcgatgtggcggctttttttcttgagtcgagaataccagaagaaaaacaaaaatatttccttgctcattatgatcatcatctggattttgaaaattctcgtatggaaatactatttcatcaatttacccaagatgttttatggtttttatggaccttgataaaagaagaaaataatgaaacatttgaaaattatgcctcaataagaataaatcgcgcgtatgaactgatgaaggagttgatgaaaaatgggtttatttagtgaaaataaacgattagttcacgtcggttatttttgtggattattatccggtttattttgggcaatatcaggaatttcttacgaaaaattatatatagatttcccgatgctgaatgcgtttgcattaaatattattatattaagtattgctgagattactttgctgttaatggcttatggttatttgataaaaagaaaattattaccgcactttaataaggtttctttgttagcgattttgggaggttgtttgggcggtcctgttgggatgatttgctatttacagtccttacaatatgttggagtgagttatgcggcgacgatttcaatttgttatccaattatagcatctattttatccatcaagtttttagctgtgaaagcatcaagaagaacactattttcttttgtttttattgtcttattattaatgcctatcatgtatcaaggtgaaaattcagaaatcaggattttaggcattatttttgctttttcttgtgcattatgttgggcacttgaaattgtgatttccagttatgtcatgcaacactatccatccgatcaagtttatttatttagacaaataggatcgtctttaggatattttcttattattcttttcatgtttttttatggaacttatgacaatttaattgattttaatttttttaaggatgtaaatctatggaaattggagtggatagttattatttcctcaggattttcttattttctatattataaatcaattgcaattttgaatccaattagagcaatggcattaaatattacatatagtctttgggcgattgtattaagtgcggttcttttatcaaaggaaattagtatctttctgcttatgattggaataattgtattgatgaatatttttattgtggcgaaaggagaagaaaaatgaatgccattattttagcggcaggtttaggaagtcgttttagagagattacgcagaagaagcataaggctttacttccgttacctaatggaattcctaatattgagcaaacaattatttatttaaagcaagcaggtattcatgaaattcacattgtaacaggttatttttctgagcagtttgattttttaagtggtaaatacggggttaatcttatttataataagttttataaaaagtacaataatatctattcttttcattgtgctattgagcatttcggagaaagttttgttattgacagcgatgtgacactttttagcaatatttttaataatcaattaaaacgaagtcaatattttttaattcaacgaaataaaagtcataataaagaatggattccgattgtgaaagataaccgagttattgatattattattgacagtttggaattgcctagcttactgggggtctctttttggtcaaatcatgatgcggtcaaaataaaatcatttttggctgattatgtgaataatgaaaatttattacttgattcatcattgtattgggataatattccaatggaaaatcttacagaattggatattggtgtaaagcttttgaatataaaggaagcttatgaaatagataatttatctgagtatgaatttatatttaaccatttaaaaggtgaatagtatgaaaaaattatcgctgagagaacttcaattggtatcattagatattttgaaatattttgatcaattatgtgctaaaaatgatattcaatattccttaggcggaggaacattaatcggtgcagtaagacacaaaggatttattccatgggatgatgatattggtgtctatatgcagcgtgatcagtatgaaaaattcgttaatgtttggaaaagtgagacgcatgctcaatatgaattgtctttagcggaggatattcatggtatgtttccgggtgagatgacaaaaatttttgataaaaatactgtacttatagatacgaaaggaagaaaaagtggcatatttatagatatttttatttatgatggtgtgccaaatgacccggcggtgatttataaaactatgaagaaacatcgtcgccttaaattgaggttttcatcttgtcgtaagagatggtataaagctaataatgagagtttaattcagtctatattttttagattatcccagtatttatttaataagatgatgttaaatttaaaacaatttcaagacaaatatcctattgatgaggctgaatatataggactcgttttatcagattacggtggctggaagaagtcttatatgcctaaaaaatattttaactccgttgtttatttagattttgaagagagtaagtttcctgttatgaacggttatcatgaacatttgaccatgtattatggtgattatatggaactgcctcctgttagtgaacagaaacctcaacacacgattgaagcttatatattagattaggcaatctattccttttttattaaaaatcagcaaaagagcggtcattttgctgatttttttttgatttatcggcataataggtgctataaaaattttatgggagtcattatgtgtaggggaaatttatatattatttctgccccaagcggagcagggaaatcttctttgatttcagcattattggaacgggataaaaacgatagtatgacggtgtccatatcacatacaacaagatccccaagaccgggtgaaattgatggagtgcattatcactttgtttcacatgaaaaatttgaacagcttattttagaaaactcatttttagaatatgcgaaagtattcggtgggaattattatggtacgtcattactgaatattgagaaaaatttagcggcaggtatagatgtattcttggatattgattggcagggagcaagacaaattcgagaaaaacgtcctgatgttaaaagtatttttattttgcctccttctatttctgctttagagaagcgtttgattgggcgtggtcaagatagtcaagacattattgcaaagagaatggaaaaggcagcggatgaaatctcccattatgatgaatatgattatgtcattattaatgctgattttgatcaagcattagtagatttagaacatattttgcgagctgaacgattgactgtaaattatcaaaaaatgcaaaatgcggctttaattcatcaattactagtaaaataattttggttttagtatcatgagagcgttttttgtgaatacattaatggagaaattatggctcgagtaacagtacaagatgcggtagaaaaagtaggtaatcgttttgatttaattttaactgcggctcgccgtgcgagagaattgcaattacataagcgtgaacctttagtgccggaagataatgataaaccgacagtcattgcgttgcgtgaaattgagaaaggattaattaataacgatattatgaacgctcatgagcgtcgtgaggcattagaacaagaaactgctgaattgaatacaatatcgctgttatatcaaaataattaagtaaagtgcggttcttttttgtaaactttatcaagtacatttcaatcttttttgcatattaatcaatagtcaggtgtcttttgtatttatttgagagtttagagaaaattatcagaggatatttgtctccgtcacaaattgagttagttcggcatgcttttgttattgcaagagatgctcacgaaggacaagcgagggctagtggcgaaccttatattactcatccggttgccgttgcttctattattgcagaaatgcatttggatcatgaagcagtggttgcagcgttattgcatgatgtaattgaggatacgccttatactgaagagcaattaaaagaagagtttggtgcgagtgttgctgaaattgtggagggtgtttcgaaattagataaattgaaatttcgtacacgtaaagaagcggaagtagagaattttcgcaaaatgattttggcaatgacaaaggatattcgtgtcgtgttgattaagctagccgaccgtactcataatatgcgtacactgggtgctttaagaccggagaaacgccgtcggattgcgaaagaaaccctagaaatttatgctcctttagctcatcgtttagggatagagcacattaaaaatgaattagaagatttaggttttgaagcaatgtaccctcaacgttatgcggtattacgaaaagtgattcaaattgctcgtggtaatcgtaaggatatgattgagtgtatcgcttcagatattaaaggacgcttgacggaggcgggcatcacggcacgagtatttggtcgtgaaaaacatctttatgctatttaccaaaaaatgcgattgaaagatcagcagtttcattccattatggatatttatgctttccggacggtggtaaaggatgtggatacttgctatcgagtacttggtcaaatgcacagtttgtataagccgcgtccgggacgggtgaaagactatattgctgtacctaaagccaatggttatcaatctttgcatacatctatgattggaccacacggtgtacctgtcgaagtacaaattcgtacggaagaaatggatcgtatggctgaaatgggtgtggcagcacattgggcatataagcaatcaggacgaaatgacagcacaacggcaaaaattcgagctcagcgttggttgcgaagtcttgtggaattacagcaaagtgttggtaattcttttgagtttattgaaagcgtaaaatcagagttctttcctaaagaaatctatgtatttacccctaaaggacgtattattgagttgcctaaaggtgcaactgcggtcgatttcgcttatgcggtacatacagatgttggacatcattgcgtggcagctactgttgatcgtaaaccttatccgctttcctttgcattacaatcaggtcaaacgattgatattagtatcgatggaaattcaaaaccaaattcggggtggctaaattttgttgtgacagcgaaagctcgcacaagtattcgccaagcattgaaatcgttaggtgccgatgatgctgttaatttaggcaaacgccaattactgcaggcacttttacctaaaaaacttagtgatattccaccgcacattgtgcaagaagttttagatgatttgaaattaacgagttttaatgacttgctgatggaaattggtttaggaaatcagattagtggagcaattgcttatcgattggtgggtgagccattgaaaattgatacggatggtaatcctaaaaataatacggaattattgcaaattaagagctctgaaggtttatcaacaacctttgggcaatgttgtcatcctattccgggagatccaattgtggcttatacgagttcagggaaagggcttgttattcatcataaggattgcgctaatttgaaaaaacgtaaagagaatactgaacattatatgcaggtacaatgggaggatgaagatacctcgattgagtttgaaactgagttgcgtattgaattactaaaccaacagggtgctttacctcatttaatgtcaatgatttcttctttggatagtcgcattcatagcatttggacggaagagcaagacggtcgcctttaccaaattgttattttattaaccgtgaagaacacagaacatttggagcaaattatgcgtaagattaaaagtgttcctggctttttatctgtcaaacgcaacattaataattaatgggtggacaattcttagacgctattccacttacttctttgtcgggtgtcggtgccgcaatagcagaaaaattaggtagaattgggctttttagcctgcaagatcttctgtttcatttgcctattcgttatgaagatcgtacccgtattacccctattattgatcttcgtattgatcaacatgcgacaattgaaggaatagtacaaacttgtgatattcaattgggtcgtcgtccagttcttgtggtgacgctttctgacggtactgccaaaattgccttacgcttttttaattttaatgcaggtatgaaaaatggctttcagcttggagcgagggtgaaagcctttggggaaattaagcgaggtcgatttatggctgaaattcatcaccctgagtatgaaattattcgtgataatagacctcttcagttagcagaaacgctcaccccaatttatgcgacaacggaaggcttgaagcaaaatacattacgaaagttgactgagcaggcattagtgttgctagaaaaaatgccattagcggaattattgcctagagcttttaatcctcatgattttagtttaaaacaggctatttacgttttacatcgcccaccaccagatatttctttggaattgttggggcaaggaaaacaccctgcacagttacgtttaatttttgaagaattattagcacataatcttgctatgcaaaaagtgcggtgcggatctcaacatttttcagctttacccttacgttatcaaacagcattgaagcaaaattttcttgatttattgccatatcaaccgacaaatgcacaacaaagagttgttgctgaaattgaatatgatctgggacgttctttcccaatgatgcgtttggtacaaggcgatgttggctccggtaaaactttagttgttgccttagctgcattaactgctattgataacggtaaacaggtagcactcatggcaccgactgaaattttggcagagcaacatactgcaaatttccaacgttggtttgaaccgttaggaataagagtgggttgtttgacaggaaaagtaaaaggcaaatctcgtcaagccacattggaggagatatcccaaggcaatatacaaatggttgttggtactcatgccttgtttcaagatgatgtcaagtttgccgaactggtattagttgttattgatgaacaacatcgctttggtgtacatcaacgcctgatgttgcgtgaaaaaggaaagtatgccggtatttatccacatcaattaattatgactgcaacacctattcctcgtacattggcaatggtagcctatgcagatttagatacttcaattattgatgagttacctccgggaagaacaccaattcaaactattgcggtatctgaagaacgcagaaccgaaatcgtcgctagggtgtataatgcttgtgttaatgaaaaacgccaagcgtattgggtttgtactttgattgatgaaagtgaagtattagaagcccaagcagcagaaagtattgcagaggatctacaaaaagccttgccggtactacggattggtttgatacatggcagaatgaaagtgagtgaaaagcaagaagtaatgaggcaatttaaaaatgctgaattgaatttgttggttgctacaacagtaattgaagtcggggttgatgtacctaatgcgagtttaatgattattgaaaatgcggaacgattaggtttggcacaattacatcaattgcgtggtcgggttgggcgtggtagtacggcatcctattgtgttttaatgtataaatcacctttgagtaaagtgtcgagaaaacgtttagaagtaatgcgttcaagtcaagatggcttctttatttctgagcaagatttagaaattcgtggaccgggagaagttttaggtaccaaacagacgggtgttgcagagtttaaagtggctgatttaatacgagatcgtaaaatgctgcctactgttcaacattatgcccgtctattaattacacgatctccaaagttagcagatgacctcattcagcgttggcttaaacataaagaaatttataccaatgcgtaagtgaacatttaacttttgtggaactgagaattatataagtaaagagcggtcaatttttaggaaaattttatgaggttctcaatacaaccaacaattttattttttgattcaggtgtaggtgggttgagtgtttataaagaaactaaacaacttttaccggattgtcattatttatattgttttgataacggattttttccttattcagaaaaggacgaaaaagatattattgaccgcactttaagaatttgtcagaaaatcaatcaaacttatcccttagatttaattgtaattgcttgtaatacggcaagtacggttgttttgcctgaattacgccggaatttttctattcccatcgtgggaaccgtacctgcgatcaagcctgctgcagaaatgtcagaaacaaaacatattggtttgattgcgacgaaaggaactataaaaagaacttatgttaatgatttgattaaaaattatgcacatcattgcatggtggaaaaaattggtagcactaagttggtagagattgcagagcaaaaattacgaggcggtgaagttgatcttaatgtcctaaaacaagaacttagtccatggcaaactatgaaatcacttgattctgttgtattggggtgtacacattttcctctaatcaaagaggaaatagaatgctgtttaccgcaggtaaaattttttgtgagttctggtaaggcaattgcgaaacgggttaaatttttattaaaaggtatagaagtgcggtcaaaaattcagaaaaaaaatttgattttttgtactaaacctcttgaagatgataagtctgttcaacaaattttagattttggggaatttgagaatttagtgatattgtctgattgagactaagcaactagataaaaataaaacttgtattttgtaattgaatagatttttactcagataaatgtaggaaaattgagcaaacagtttttattttagacaaaggagagtatttttaaaaaaaattataaaaaaagcttgcattgaaatataaaatgcctataatgcacggcacacaacgacacgctgttgtgagaggttaagcagtgtgtcgttattttttgttctttaacaaactatcagacaaactgtgtgggcacttgtgagactgtattaataagagattaaaagagtaagataagtgcttaaactagagaaattcatagagaaaagatggataaaatagtcagtatttattgagcgaagagattaaattgaagagtttgatcatggctcagattgaacgctggcggcaggcttaacacatgcaagtcgaacggtaacggggagggaggttactttctctgctgacgagtggcggacgggtgagtaaagcttgggaatctggcgaatggagggggatagccacgggaaactgtgggtaataccgcgtaaggtctaaggactaaaggggtgggactgagaggccacctgccatttgatgagcccaagtgggattaggtagttggtgaggtaagggctcaccaagctgacgatctctagctggtctgagaggatggccagccacactggaactgagacacggtccagactcctacgggaggcagcagtggggaatattgcgcaatggggggaaccctgacgcagccatgccgcgtgaatgaagaaggccttcgggttgtaaagttctttcggtgatgaggaaggcgattagtttaagagattaattgattgacgataatcacagaagaagcaccggctaactccgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgctcctagtacgagaggaccggagtggacgcatcactggtgtaccagttgtttcgccagaagcattgctgggtagctaaatgcgggagagataagtgctgaaagcatctaagcacgaaacttgccttaagatgagttctccctaacgaagagttagtaagggatgtttgagactaagacgtagataggtggggtgtgtaagtgtagtgatatattgagctaacccatactaatttcccgaggggcttaaccatacaatcttgagtgttttgcatagaggaagaagcgggacaggatagagagaggaagacttgaagtagaggcttgtttttttattgaagaagagatagagacgggatataagagagaggaatttaacttggcggcgatagtgcggtgggaccacctgacaccatgccgaactcagaagtgaaacgctgtaacgccgatggtagtgtggggattccccatgtgagagtagggcaccgccaagttttttatgagtttattttgttagtttatttatattagtaagctaacaaaataaattttggcagtcatagtgcaatggaaccacctaactccttgccgaacttagaagtgaaacgttgttacgccgatggtagtgtggggattccccatgtgagagtaggtcactgccaaatatcaaatttagcggagtggtagttcagctggttagaatacctgcctgtcacgcagggggtcgcgggttcgagtcccgtccattccgccaatttatatctgtttaggggcgtagttcaattggtagagcaccggtctccaaaaccgggtgttgggagttcgatcctctccgcccctgccatgttttccttagtcatatatttcattaaaattttgcatctcatatcttttcataatttcaaaaatgcaatattctattacaagacgaagaatatgcagcagttaatagaaattttggtggcattttcttatcaaaaaactcagtaaaatctatgtggagacaattgtgggaaataaaatcttaaaagggatttttttgctctatccgccgctgcgttgaatagtagtattggaatttttagcaaaaatttattagagcagaacctaaatattcaatctattgccttttttaaaacaattatcgcttttgctatgatcagtctggtgttaagtcgctcatcatggcaagaacagaaaaatcaaataaaaccttttgcaaaaaatacagtgaacctacttttccaaatagctatttgcgcatttctggggattttaccttatttttctttgaaaccactgcttatcagtatggccatgccgctaatgtggtagtcgtactaatggccactgctgccgtatcctccctgctcggagggctatattattgtcagagccattgaaggtttccgctattgctggcacttgttttgccgtatctggcgtatttatcatttcttggtcgggctctagtcaatggctatctattctatatgccattcttgcaggtagtggctacggtttattttccgtactcatcaaaaaatttaatttaaatggtggcataccattaacacgattattgatgatgtttggagcactatatttgttctatccatttgtcacacattttcaacatatagaaatccagtggaatacgaccgtcatactcaatcttgttgcacttgctttactacccacgctgattggtttttactgcacaaccaaggcgttagtttatctcagtgcatcgaaagtacaggtaactgaactgtcagaacctatcttcactatggtactggcatggctactactcaatgaagttccaaatcaaactttctttttaggtgcgttttgtattgtgttaggcattgcgttgatcaatcaaatgttgcaattcaaaaagtgagaagtgagttctaacaggttatgtacgctatgtgtagggtattttgatgggtatgagttttatatttaatcgatacgatttttaggcgagctgaaaactcatttttatacttacttacttcctttcttttctacaaatttaattattttttgtattatttaaataaattaattgagtgatttcaaaaaataagtatgatagccggagttttttgtttatctcttttagggagcttttatgctttatttggaatttttatttttacttttaatgctttatgtaggaagtcgctatggcggtattggattaggtgttgtatccggtattggcttagctatagaggtctttatcttccgtatgccagtaggtaaggcaccaattgatgttatgctaattatccttgctgttgtgacttgtgcgtcggtacttgaggcagcgggcggtttgaaatttatgctacaaatggctgaacgtgtattacgtagcaatcctaagcgtgtaactatccttggacctttagtaacatattttatgacatttatgctcggtacagggcattctgtttactctattatgccaattattggtgatgtagcactaaaaaataatattcgtccggaacgacctatggctgcagcatctgttgcatctcaacttgcaattacatctagtccattatcagcggctgttgttttttatcttgggaaaatcaccgcacttccaggatttgagcatattaccttattagatattatttgtgttactgtacctgcgacattggcaggaactattgcattgtcactttatagtttacgccgtggtaaagagcttgaatatgacaaggaatatcaacgtcgtttacaggatcctatttggcgtgagcgtattttaaatacaactagtacaactttaaatgaagtattaccgccagcagctaagcagtcggtatatttatttttactctcgttagttgtgattgtaatgatcgcaatgtttcctgaaattcgtactatcggtagtgcttctaaacctatttcaatgtcattaattattcaaatgatgatgctatgttttggcggtattaccttgttggttacaaaaactaatccgcaaattgtaccgaacggtgttgtatttaaatcaggaatggttgcagcaattgctatttttggtattgcctggatgagtgacacttattttcagtatgcaatgccacaatttaaggcaggtattgtagatatggtgaaagcctatccatggacttttgctttggcactatttgctgtttcagttgttattaatagccaagcagcaacagcggttatgatgttacctgttggaattgaattaggtttatctccagcattattagttggtctgatggcggcaacatatgcttatttctttattcctaattatccatcagatattgcaacggtgaattttgatgtgacaggtacaacgaaaattggtaaatattactttaaccatagctttatggctccaggtttaataggcgtttttacggcttgtgtggttggctacctcattgcacaagttgtgattcgttaagttcatcaaataaaaagtgcggtttaaaaccgcactcataccattaagagtttgatacgagagatattccgtaaaaagcaacatcactcggcattgtgaggtaacttttttgctttggttgtttgctaatttgtacttcacgtaattctttgacatgggcatagagatgtttttagaataaaacctcattcaatcgtcaaatgtatcttgctaaaaactatttggaatgatagaatctcaagccattttagtaaattgctgatagttttatactctcagcaatttacattttttaaatacaccgtttgattgcaaaagagttaggctaaatcaaactattagcttaatgcaatccgcacatcagaagtaaggttcagagggcggtacctagcaaacgggttcaagcattgatataaaatttattataaaatcgaccgcactttatgttgtcgaactgaattttatattgaatcggtctcactaatatttacagaggaacccaaatggtttactcctataccgaaaaaaagcgtattcgtaaaagcttcggcaaacgtccgcaagttttaaatgtaccttatttattaacaattcaacttgactcttttgataaatttatccaaagagatcctgacggtcaacaaggtttagaagctgcattccgttctatatttcctattgtcagtaacaatggtaatacagaattgcagtatgtcagttatcaattaggagaacctgtttttgatgtaagagaatgtcaaattcgaggtactacttatgctgcatcattacgtgtaaaattacgccttgttagctacgataaagatgcggcatccggcacgataaaagacataaaagaacaagaagtttatatgggagaaatcccattgatgaccagtaatggtacttttgtcatcaatggtactgagcgtgttgttgtatcacaattacatcggagtccaggtgtattttttgatagtgacaaaggaaaaacccattcatcaggcaaagtactttataatgcacgaattattccttatcgtggttcatggttggattttgaatttgatccgaaagataatttatatgctcgtattgaccgtcgtcgtaaattaccggctactattattttacgtgcattaaattacactaccgaagaaattttggatttattctttgataaggtttcgtttgagatcaaagataataaattactaatgactttagttcctgaaagattgcgaggtgaaaccgcatcttttgatattgaagcgaatggtaaagtgtatattgagcgtggtcgccgtattaccgctcgtcatattaaagcattagaaaaagataagattacacaagttgaagtaccgacagaatatatcgtaggtaaagtttcagctaaagattatgttgatttaacaacaggtgagattatttgtccggcaaatatggaaatttcgttagaattgttagagaaattatcacaagccggttataaaaacattgaaactttatttaccaacgacctagattttggtccgtacatatctgaaacattacgtgttgatccatcctatgatcgtctaagtgcattagttgaaatttatcgtatgatgcgtccgggggagccaccaacaaaagaggcggcagaaggtttatttgataacttatttttctcttccgaacgttatgatttgtcagctgtaggtcgcatgaaattcaaccgctctttgggcattgaagatactacaggtagcggtacattgagcaaagaagatattgttaatgtaatgcgtaaattgattgacattcgtaatgggcgtggtgaagtagatgatattgaccacttaggtaatcgtcgtattcgttcagtgggtgaaatggctgaaaatcaattccgcattggtttagtccgtgtagaaagagcggtaaaagaacgtctttctttgggcgatttagagtcggttacaccacaagatttaattaatgctaaacctatttcagcagcagtaaaagagttctttggttcttcacaactttctcaattcatggatcaaaataatccgttatcagaagttactcataaacgtcgtatttctgcattaggtccgggtggtttaacacgtgaacgtgccggctttgaggttcgagatgttcatgcaacgcactatggtcgagtttgtccaattgaaacccctgagggaccaaacattggtttgattaactcgctatctgtttatgcacgtactaatgattatggtttcttagaaacaccatatcgcaaagtggtaaacggtcaagtcacagaagaaattgaatatttatctgcgattgaagaaggaaaatatgttattgctcaggcaaactcaaaccttgacaatgagcttcgttttactgatgcctttgtaacttgtcgtggtgagcatggtgagtccggattatatcgaccggaagaaattcattatatggacgtttcaactcaacaagttgtgtccgttgctgcagcacttatcccattccttgaacatgacgatgcaaaccgtgcattaatgggtgcaaacatgcaacgtcaagcagttccaaccttacgtgctgataaaccgttggtgggaacaggaatggaaaaacctgtagcactggactccggtgtagcggtggtggcaaaacgtggaggtactatccaatatgttgatgcttctcgtattgttgtaaaagtcaatgaagatgaaactattgcgggtgaagcggggattgatatttacaacttaattaaatatacccgttcaaaccagaatacttgtattaaccaaattccttgtgtgcaattgggagaaccgattgaacgtggtgaaatcttagctgatggaccatcaacggatctcggagaacttgcacttggtcaaaatatgcgtgtcgcattcatgccttggaatggttataactttgaagactcaatgttagtgtctgagcgtgtggtacaggaagatcgtttcactactattcatattcaagaattatcttgtgtggcacgagatactaaattaggttctgaagaaattaccgccgatattccaaatgtaggtgaagctgcgttaagtaaacttgatgaatcagggattgtttacatcggtgctgaggttaaaggtggagatattcttgtcggtaaagtaacacctaaaggcgaaacccaattaactccggaagaaaaactgctacgtgctatttttggtgaaaaagcatctgatgttaaagactcttccttgcgtgtacctaacggcacatcaggtacagtcattgatgttcaagtcttcactcgtgatggtgttgaaaaagataaacgtgcattagaaattgaagaaatgcaattaaaacaggctaaaaaagatcttgtagaggaattagagattttagaagccggtttgtttgctcgagtacgtaatttacttctttccggtggtttcaatgataaacaattggaaaacttagaccgcactcaatggttagagcagactttagctgatgaagagaaacaaaatcaattagagcaacttgctgaacaatacgaagagttacgtaaagatttcgaacataaacttgaaattaagcgtagtaaaattatccaaggtgatgatttagccccgggagtattgaaagttgtcaaagtttatcttgcagtaaaacgtcaaattcaaccaggtgataaaatggcgggtcgtcatggtaacaaaggggttatctcgaaaattaaccctgttgaagatatgccatacgatgaaaacggtcaacctgttgatattgtcttgaacccgttaggggtaccatcccgtatgaatatcggtcagattttagaaactcatttgggactggcagctaaaggcattggtgatcaaatcaacgcaatgataaaacaaaaacaagatgttgaaaaattacgtggctatatccaaaaagcttatgatttaggagatggttcacaaaaagttgatctttcgacctttaccgacgaagaagtattgcgtttagcaaaaaacttgcgtaaaggtatgccattagcaacgccggtatttgacggtgcgcatgagaaagaaatcaaagcgttattagaattaggtgggttaccaacttccggtcaaattaccctgtttgatggtcgtacaggtgaaaaatttgaacgtcctgtaacggtaggttatatgtatatgctgaaattgaaccatttagttgatgataaaatgcatgctcgttcaacaggttcatatagtcttgttactcagcagccacttggtggtaaagcacagtttggtggtcaacgtttcggtgagatggaagtatgggcactggaagcatatggtgcggcctatacattacaagaaatgttaacagtgaaatccgatgatgtgaatggtcgtacgaagatgtataaaaacatcgttggaggcacacaccaaatggatccaggtacgccagaatctttcaatgtaatcatgaaggaaattcgttcattaggtatcaacattgatcttgatgaagagtaatgggtaaccacaaaaatacgcccaagtgcggtgggatttataaaagttttaaccgcacttgaataattttaactccgataggagcaaatcgtgaaagacttagttaagtttttaaaagcacaatcaaaaacctctgaagattttgatgttattaaaattggtttagcatcaccggatatgatccgttcttggtcatatggtgaggttaagaagcctgaaacaattaactaccgtacattcaaacctgagcgtgacggtcttttctgtgcccgtatttttggaccggtaaaagattatgagtgtctatgcggaaaatacaagcgtttgaaacaccgtggagtgatttgtgaaaaatgcggtgttgaagtaacacaagccaaagtacgccgtgaacgcatggggcatattgagcttgcctcacctgttgcacatatttggttcttaaaatcattaccgtcccgtattggtttattgttggatatgccactacgtgatattgagcgtgtactttattttgaatcttacattgttattgaaccgggaatgactgatcttgagagaggtcaattattaacggaagaacaattcttagacgcagaagatcgttggcaggatgagtttgatgcaaaaatgggtgcagaagcaattcaagccttgttacgtgatatggatttagaagttgaatgtgaaacattacgtgaagaattgcaatcaacgaattctgaaactaaacgtaagaaaattacaaaacgtttgaaattgttagaatcttttatccagtcaggcaataagccggagtggatggtgatgacagtattacctgttttaccaccggatctacgcccattagtacctcttgacggagggcgttttgcaacatccgatttgaatgatttatatcgtcgtgtaatcaatcgtaacaaccgtttaaaacgcctattagatttaattgcaccggatattatcgttcgtaacgaaaaacgtatgttacaagagtcagttgatgcgttattagataatggtcgtcgtggtcgtgcaatcaccggttcaaatcgtcgtccgctaaaatctcttgcggatatgattaaaggtaagcaaggtcgtttccgtcagaatttattagggaaacgtgttgattactcaggtcgttccgtcattacagttggtccatacttgcacttacatcaatgcggattgccgaaaaaaatggcattggaattattccgtccatttatctacgctaaattagaaagtcgtggctttgcaacgactattaaagctgcgaaaaaaatggttgagcgtgaagatgctattgtttgggatattcttgccgatgttattcgtgaacacccaattttgctcaaccgtgcaccaacattacaccgtttaggtatccaagcatttgagccaattcttattgagggaaaagctattcagttgcacccgctggtttgtgcggcatttaatgctgacttcgatggtgaccaaatggctgtacacgttccattgacattagaagctcaattggaagctcgtgcattgatgatgtccacaaacaacattttatccccggcgaatggtgagccgattattgttccttcacaagacgttgtattaggtctctactatatgacacgtgataaagtcaacggtaaaggcgagggaatgttattacaagattcacgtgaagcagaaaaagcctatcgtacaggtcaagctgaattgcattctcgtgtaaaagtgcgtattactgaatatgttaaaaatgcaattggtgaatttgaacctcaaacacatttagtcgatactacaattggtcgtgcaattttatggatgattgcaccaaaaggcatgccatttagtttattcaaccaaactttaggtaaaaaagcgatttctaaattaatcaacgaaagttatcgtcgtctaggattgaaagagagtgtattgtttgctgaccatattatgtataccggttttgcttatgctgcacgttccggttcatctgttggtattgatgacatggttattcctcagaaaaaatatgaaattatttctgctgcggaagaagaggttgctgaaattcaagaacaattccaatccggtcttgtaacagctggtgaacgctataacaaagtaattgatatttgggctgcggcaaacgaacgtgttgctaaagcgatgatggaaaatctttcgcaagaagaggttatcaatcgtgaagggcagccggaaaaacaagcctcattcaatagcatctttatgatggcagattctggtgctcgtggttctgcggcacagattcgtcagttagcggggatgcgtggtctaatggcacgtccggatggctcaatcattgaaacaccgattacagcaaatttccgtgagggtttaaatgtattacagtactttatttcaacccacggggcacgtaaaggacttgcggatacagcattaaaaaccgctaactcaggttatctaacccgtcgtttagttgatgttgcacaggacttagtgattatcgaagatgactgtggtacacatgaaggaatcgtaatgactccacttatcgagggtggcgatgtaaaagaagcattacgtgatcgtgtattaggtcgtgtagcggcagaagatattttaaaaccaggcacaaacgaagtgttaatttctcgtaataccttattagatgaaaaactttgtgatgtcattgatgaaaattctgttgatagcatcaaagtgcggtctgttgtaacttgcgatactgattttggtgtgtgtgcaaaatgttacggacgtgatttagcacgtggacatttgattaatcaaggtgaagctgtcggtgttattgctgctcaatcaatcggtgaaccgggtacacagttaaccatgcgtacattccatatcggtggtgcggcatctgctgcggcaaaagaatctagtgttcaagttaaaaataccggtacattacgtttaacaaatgttaaattcgtaacgaataaagaagggaagttagttttaacttcacgtaacactgagttgacaattattgatacattcggaagaacaaaagagcattataaagtaccttatggtgcggtattaaaccatgctgatggtgaagaagttacggcaggtgaaaccgtggctaattgggatcctcatacaatgcctgttatttctgaagtcagtggttttgtgaagtttgtggagattgttgatggactaacggtaactcgccaaaccgatgaattgacagggttatcttcaatcgtagttcaagatgtaggtgaacgtgcaacagcagggaaagatttacgtccggcattaaaactggttgacgctcaaggtaacgatatttttatcccaggcaccgatgttatggcacaatatttcttaccgggtaaagcaattgttaccttagatgatggtgcggaagtctttgttggtgaaccattggctcgtattccacaagagtctgtaggaacaaaagatattaccggtggtcttcctcgtgtagcagatttatttgaagcacgtaaaccaaaagaaccggcaattttagctgaaatttctggtatcgtgtctttcggtaaagaaaccaaaggtaaacgtcgtttgttaattacaccgatggaaggtgaaacatacgaagaaatgattccaaaatggcgtcaattgaacgtatttgaaggtgagttggtgcaacgtggtgatttaatttctgatggtgcagaaacaccacatgatattttacgtttacgtggtgtacatgccgtaacagattatatcgttaatgaagttcaagaagtttaccgcttacaaggggtaaaaattaacgataaacatattgaagttatcgtacgtcaaatgttacgcaaagcgattatcactaatgcttatgactctgaattcttagagggagagcaggttgaagtcgctagagttaaaattgtcaaccgtaaacgtgccgaggaaggtaagccacttgtagaattcgaacgtgaattattagggattactaaagcgtcgttggcaacggaatcctttatttcagcggcttcgttccaagaaacaactcgtgttctaactgaagcggcagttgcaggtaaacgtgatgaattgcgtggcttaaaagaaaacgtgattgttggtcgcttaattcctgctggtacaggttttgcatatcaccaaaaccgccaaaaaaatcgattggtaggtggtatggaaaatacgactgaggttaaattatctgcagttgatgaggaagaaattgcttctgaatttaccttttcagcagaagatgcaacagcaaatttggcagagatgctaaatatggcagatgatgcagaataataagtagcttggtacaaaatatttaattttaaaaaccgatatttatgtttgtaaatatcggttttattgtttagataataaagtacatgcaacattattaaaaccgaaaatctgtgtcatattcaatgatcacgactattgttcaaaattttctgtaatatagaggaaacggataaacttcatttttaaaggatttgctgaaaggtattttgtatgaaaaaagctttcaacagtgtgaaatgcctgctataacttttgtaattttcgtttccgttttatacaatattcagcaacataaatgtcttcaagtaattaaccttaatagtggaacacctcatggaaaaaagcttatcccttattcctaatatcagaatgaaacgcgaaggaatgacaaatacggaaaaacgagtagttgactggttattagatgcaactaaatttaataaatccacagcattgaatgctattgcaaatgatcttgacgtatctgaggctttaattgtaaaagttgcaaaattactcggtttctccggttttcgtgatttaagaaaacaaatcactacttcttttgaagaaaatcaattagatacatttgaactttccagtcaagatacgcctcaagatcttgtagataaggtttttaatgtctctttacaaacaatctctgaaggcaaggcgattttaaattccaaagtcatttctgaagctgcaaaatgcttttttaatgctcaaaatagagatctgtatgctgctggtggttcaaatacaatctgcgatgatattgaacataaattcttgcgtatcggaattcgctgtaatacctatcgagatattcatttaatgatgatgtcagcctcattactcactgaaaatgatgtgatcttagtggtttctcattcgggtaaaacaaccgatttgttaaaagttgtctatgaagctaaaaaaaatggagcaaaaatcatctgcatcacacatagtgatatttctcctattgctgttatttcggattttgtaatttgtacgcccgcaccagataccccattgctgggaaaaaatgcttcagcaaggattttacaacttattttagttgatgccttctttgtctctgtagctcaacaaaatattcacttatctgaaatgaacttagagaagacatttactgcaacaaaatacttcagaaaaaaatagcttccttccattaaaaaggtccttttttagcatcaaaaactttacaatattttaatatttgtgaagctgatcacttttttaccccttttgataaagtataattataaaaaaataaataaaaattataaaaatatgaagtttcatcattttttataatttttagttttctattaacctacataaggagtaatttcatgaaaaggttcaaaacactaaaatcctgtttggctatacttggcttagtttgctctgtttcggtttattctgctgaatatgccgtaatacttaaaacgctttcaaatcctttttgggtagcaatgaaagaagggattgaaaatgaggcaaaagtactgggagtagatgtagatatttttgcttcaccatctgaaggagattatcaatcacaacttcaattattcgaagatttaatcaataagaattataaaggtatcgcttttgctccactttctcctgcaaatcttgttatgcctgctgccaaagcctatcggaaaggtatttatcttgtgaatttagatgaaaaaatcgatattaaaaatttacaaaaggcaaaaggcaatgtagaggcatttatcacaacagataacgtagctgtaggtggaaaggctgctcaatttatagtagataaattaggttctgaaggaggcgaagttgccattattgaaggaaaagcaggcaatgcttcgggtgaagctcgtcgtcgtggagcaagagaagtttttgttaaaagttcgagcattaaattagttgctagtcaacctgcagattgggatcgtattaaagcactggatgtagcaaccaatgtactatcaagaaatccaaatctaaaagccttttatgtcgcaaatgatacgatggcaatgggggtagcacaagctgttattaatgctgggaaacaaggtaaaattttagttgtgggtaccgatggagttcctgaagcaagaaaaatggttagcgaaagaaaactcactgccactatcgctcaagatccggcaatgattggtgcaaaagggttgaaactgcttgttgatgcagcgagagcaggaaaacaaatacctgttgattttgagccaaaaattgaaactgttgattcaatattaatttctcaataatacggaagtatgtggggattttaatctccacataggagtgtttttctatggcaatcccattaatacaaatgaaaaatatctcaaaaagttttggtgttgttcaggcattaaaaaatgtcaatcttgatatttatacgaatgaaattcacgcattactgggtgagaatggagcgggtaaatcaactttaatgaaagtcttatcaggattgcatatgccttcctctggttcaattatcattaaagataaagaatatgatcatttagatcacaaaatcgcaacagaacttggaattgggattatttatcaagaattaagtttaattgatgaattaagcgtacttgaaaatctttatatcggtcgtttaccaacaaaaaaattttggggtattcccattgttgattggtcaaaaatgcgttctcaagcgtctattattttattaagactaggaattaaagttgacttagatgagaaagtaggaaatttatctatttcttacaagcaaatgattgaaattgctaaagttcttatttcagatgtaaaaatcatcattatggatgaacctacctcatcattgactaactcagaaattgattacttatttttcattatgaatcaattacgtaatgatggaaaagcgattatctacatttctcataaaatgaatgaaattcgccaaatttgtgaccgttatacaattcttaaggacggaagtagtgtggcttccggtatgataaaagaaatcagtaatcaagagattatccgcttgatggtaggacgtgatatagaatctcggtttatcagcagacaacatactgtgagtaatgaggttatttttgaagttaaaaatcttacaggtaaaaaatttaaacaagtcaataatgtttcattttccttaaaaaaaggggagattttaggctttgccggtttagttggtgcaggtcgtacggagttgatgaactgtatctttggcattgataaacgcatttctggggaaatttatttaaacggtaaaaagattacaccgtcatcaccattagaagcagtgaaaaaaggtatggcgtatatcacagaaagcaggcgtgagaatggctttttttccaatttttctatcaagcaaaatattgctgtttcaaaaagtttaaaagatggtggttataaaggtgcggtgggaattttttctccttcaaaggaagccaaacttgcacaacagcaacaagatcttttatccataaaatgtgcgtccattgagcaaaatattacggagctgtcaggtggtaaccaacaaaaagttattatcggaaaatggattgtttgtgatcctgaagtattaatttttgatgaaccgactagaggtattgatataggggcaaaaacagaaatttataaaattatgcgtaaattagcagaacagggaaaagctattttgatggtctcttccgaacttcccgaaattatgtctgtatgtgatcgcattgtggtattccgagaaggagctatttcctctattttagagaatactaaagcgttaacagaagaaactattatgcgttgggctttaccagagacaaaagaggtaaattaatgatgaatacaggtaaatttaatttttcgcaattttgggataaatacggcacattctttattcttgctgttattgtccttatctttggatctatatccagccaatattttttgaaagccagtaatattcagcaaatttttgttcaaagctcggtaacagtcctaattggaatgggggaatttttcgctatattgatagctggtattgatttgtctgttggtgctattttagctctttcggggatggtgacagcacagttaatgattatagggatagatcctcttgttgcctctattattggtggcattctagtgggaggtggacttggtgctattaatggtgcgttagtcaattacacaggcttacatccttttattattacattaggcacaaatgccatttttagaggtattacactcgtcatttcagatgccaattcgatttacggcttttcttttgagtttgttgatttttttgctcaggatattttcttcattcctgtaccggttatattcgttgtggttattgctattctactttggttcgttacaactaaaacacgattaggtcgtaatatctatgcgttaggtggaaataaagaatcagcatattattccggaattgatgtcaagtttcacactatggcggtctttattatttcaggtatctgtgccggtcttgccggtgttgtttctacggctcgattaggtgcagcagaaccgttggctggggtaggttttgaaacttatgcgatagcaagtgcgattatcggcggaaccagttttttcggaggaaaaggacgtatttttgctgtcgttattggtggcttaattatcggtacgatcaataacggactaaatattttacaagttcaaacttactatcaacttgtggttatgggtggtttaatcatcatcgctgtcgcattggatagattaattagtcgttaattttttgaggtaacatcatgaaagtttttatttcaccatcactcatgtgcatggatcttactaaattcaaagaacagattgaatttttggatcaaaaagtagcttattttcatattgatattatggacggtcattatgtacctaacttaactctttcaccattttttgtcagtcaagttaaaaaactcgctacgaaaccattggattgccatcttatggtaactaacccagaaaattatattgatgatttggctaaagctggttgcgacatgatcactttgcatgtagaaaccatttcaggacaagcatttagacttattgaaaagatccggtatttagaaatgaaagtcggcatcatttttaatcctgaaacgccaattgaaaaagcaaaatattatttatctaaagccgataaagttacgatattgacggtcgatcctggatttgcaggtcaatcatttattcctgaaatgttagaaaaagtggcggaacttaaattattccgagaaactcatcaattaaattatgaaattgaaatcgatggctcctgcaacccgaagacttatgaaatgcttattaaggcaggtgcggatgtgcttatagtaggaagttcaggtcttttcaataattcagataatattgttgaggcttgggatatgcttgaaaaagagatagaaagaatattaagtaaaggaatgttgtaatgaagaaagtatttgttggtattgatatgggggcaacgcacattcgcatttgtgtgatggatgagcatcatcaaattctttctactgataaaaggaaaacattagaagtactcaaaaatcaaccgctctatggactaacaacattttgtaaagaatttacaactgactttattattcaacgaattgttataggacttcctgcagcagtttcattggatagaaaagaaattctttctgtacctaacttatctctttctaaacaagaactagacggacttgttccaatgttagagcaatattttcattgtgacgtacaattggaaagagatgttaatttacaattgatctacgatgttaatgattatcaacggaataataagttagtgataggtgtttatctaggcactgggatgggtttttcaatatggaaccaaggaaagctatttattggagggcatggtgtagcgggtgaacttggacacattccttacggtgatgaacatcttcaatgcgggtgtggcaatatgggatgtttggaaactaactgttcagggactgcactaagaaaatggtatgataaacaacaagcaaattatccattagagcaactttttgatagagcaattcaagagaaattcattcaaaattatcttatcaaagtcgctaaagcaattagtactgcggttaatttatttgatcctcatactttgattttgggcggtggcgtaattgacatgcaaaaattcccatttgaacaactaaaaatattgatcagaaaacacctgagaaaaccattaccttacaatgaattagaaatattaaaagctaaaccttcctctattaatggggcaataggcggtgctatttacgctataaatcaggagaaatgatgaaaacaatcgctattggttcggatcatattggtttggctctcaaaacctttttaattgaaaaattagaaaaacagggacataacttactagacttaggtgctgtttcacaagaacgtacagattaccctatttacgctgaaaaagttgcttatgctgttaagcagaatgtagctgatgttggaattttaatctgtggaacaggagttggcatttctattgcagcaaataaaatctcaggcattcgatgtgcattatgttcagatgaacttaccgcactaatgtgtcgtgaacataacaactgcaatatcattgcatttggtgccaatattatatcttcagaaaaagcgatatccttagcaacactttggctgaatacgccctatgacggaggacgacatcaaaaacgccttgatatgatggaaatgcttgaaaaaacaggaagttattgtggattggttactgaaagataaaatctataaaataatataaatatctaagaatatttaaattatgctataaccacacctatgaataaactttgctctatcggacaagccagtaaattgctaagcgtaactattcagacattgcaaaactgaggtaggaaagactgttacaacctgatgagctgaccaaaggttggtatcgcagatataaactggaaatgcttaaagcaattaatcacaatatcgtgcttaatcgagatgatttaaaaaccatttcttatgcaagagtaagtagccacgctcagaaagaagattttgttcttataggtttgttttccttgtgaataatctaaccaaatattactcggatttaatttctttttgaaggcaaaaattttattacagcagatacatttaaaacgttttttggtgaggcaatctgttattagaaaggatttaaaatgttgggggtatttatgtaggaatccccgccctttaggacggggargtgctgagttttagttatagaataaagtggcttaaatcttcgttctccacgacatcacctaatgctccggtaacgtaatcaccgtcaattatgacgttttgaccgctcatttcactggcatcaaaagagatcttatccattaagcgttccataacggtatgtaaacggcgagctccgatgttctctgttttttcattgactctaaaggctgcttcagcgatttttttcaccgcactttcagtaaattcaatatcaaccccttcggttgccatcagtgcttgatattgttcggttagggacgcattaggttcagttaaaattcgttcaaaatccttggcagttaatgcggaaagttcgacacgaataggtaaacgcccttgtaattcgggaattaaatctgacgggcgagcgacttggaatgcccctgatgcaataaataaaatgtgatcggtttttaccataccgtgtttggtattgactgttgagccttccactaatggcaatagatctcgttgtacgccttcacgagatacatcagcaccgctgtattcgccttttttgcagattttgtcgatttcgtcaataaagacaattccattttgttcaacggcatcaatggctttttgttttaattcttcaggattaattagttttgccgcctcgtcatcaattaatgcttttaacgcatctttgattttcattttgcgttttttagtttgaccggaagataaattctggaacattgattgcaattgattggtcatttcttccataccgggaggtgccataatttcaacgccgatatttggtgcggcaatgtcaatttcaatttcacgatcgtccaattgcccctcacgtaatttcttgcgaaaaatttggcgtgtgttggtattggtatctcgttcttcaatttgtccccattgatctttcgctgggggtaatagggtatctaaaactcgctcttccgccatttcttcagcacgaaaacgatttttttcaatttctgtttggcgtacaagtttcatggcactatctgttaagtcacggataattgaatcaacttctttacccacatagcctacttccgtaaattttgttgcttcaactttgataaatggtgcattagctaatttagccagacggcgggcgatttctgttttacctacgccggtaggccctatcattaaaatattttttggggtgacttcatggcgtaagggttcttgtagttgcattctacgccagcgatttcttaaggcaatagcaaccgctcttttggcatcagcttgtccaatgatatgttgatctaattcagaaacaatttcacgaggggtcatttcagacataatatattccttgacaattattcggataattcttcgatagtgtgggttaaattggtgaatacacaaatatcaccggcaatttttaatgatttttctacaatttcacgtgcggataaatccgtattttcgactaatgctcgtgctgcagataatgcataatttccgccagatccgatcgctaaaatttgatcttcttccggttgtaccacatcgccattaccggtaataattaacgattctgttttatcagcaacaataagcattgcttctaaacggcgtaatgctctgtctgtacgccattctttagccaattccaccgcactttttaacaaatgtccttggtgcatttctagcttacgctcaaaaagttcaaataacgtgaaggcatctgctgtaccaccggcaaatcctgttagaaccttaccgttgtatagacggcggactttacgtgcattgcctttcattactgtattgccgagtgatacttgtccatcaccgccaaccacgacttgccctttacggcgaacgctgacaattgtagtcatttttgattccttaactttcttttcttttatctgtcgctatatgaggattaactgtaacctttcaaggatatatacaaaataaaattttgatttttgtagagggatagaatttaacattcttatttgaagtactaaaggagcgattgcattgaaattaattggacaatcgccgagattatattaacaatctgtcggatcaagtcgctaaatacagaaaatctctttataatgaccgcacttttaccgcaagtgcggtttctttttactatttttaaaggaagataaaatgacggtattgaaaaatgatcgttacttgaaagcgttactacgtgaacctgtggatatgacgcccgtttggatgatgcgtcaagccggacgttatttaccggaatataaagcaactcgtgcaaaagcaggggattttatgtccctttgccgtaatgccgatttagcttgtgaagtgactttgcaacctttacgtcgctatgatctggatgctgctattttattttcggatattctgactatccctgatgctatggggctgggattgagttttggtgtgggcgaaggtcctaaatttgcacgaccaattgataacaaaagtgcggtacaaaatcttccgattcccgaccctgaacaagagttacagtatgtgatgaatgcggtacgtactattcgccgtgagttaaaaggtgaagttcctcttatcggtttttccggaagtccttggactttagcaacctacatggttgaaggcggaagcagtaaagcctttactaaaatcaaaaaaatgatgtattccgagccaaaaatattgcatctgttattggataagttagcagacgccgtgatactttatcttaatgcacaaattaacgctggcgtgcaggcggtgatggttttcgatacgtggggcggtgtattgggacatcgtgaatatttggatttctcattgcaatatatgcacaaaattgttgatggcttaattcgtgaaaatgacggatataaagtgccagttactttgtttacgaaaggtggtggtttgtggttagaggcaatggcaagtacggggtgtgatgcactaggtttagattggacggtaaatttagcagaggcaaaagcacgagttgggcataaagttgcgttacaaggaaatatggatccttccgtattatatgcttcgcctgcacgaattgagcaggaagtacaacaaattcttgccgattttggacaaggtagcggacatgtgtttaacttaggacatggtattcatcaagatgttccggaaattagtccgaaggtttttgtggatgctgttcatcaatattcaatatcctatcatcaataaaagtgcggtgaaaataatgcgaaatcctattcataaacgcttagaaaaatttgaaagttggaaaaatatcacatttatgctgtgtttatgtgaacgtatgtaccccaatttttatttattttgtcaaatgacagagcaaatggataaagccaaaatatatcaaaatattttgaatttagtttgggaatatttaaccgttaaaaatgccaaaattaattttgaaaatcagttggaaaaattagaaaatattattcctgatgtgaataattatgaattttttggtgttgtaccggcattagatgcctgtgaaggcttatcggaattattgcatgcaattattgctggagaaacactggagaaagcaataaaaataagtcaattgtcgttgcaaacagtgataactttgctggaaactcagcaagacaaagcgttttctgaagccgagttgaagcaaagtgaagaaattgaattggaattggatgtacagtggcaaatttatcgtacgctgaatgagcatgaagaaagagatattagactgattttagatttaaaaaatgagttgagagagagcaggttgtctaatatcggtatagaaattgctcaataatgtgatttagttatcaatttttacagatattacttttttttctataaaacttagattatgcttgacaccactgtagttgcagtaattgttgccgctggaagatgagctatctttttcggcacttttaaaaaaatttaatatgaagaaggtactaatttatgaataagacagacttaattgatgcgatcgcaggcgcagcagaattaaataaaaaacaagcaaaagcggcgttagaagcaaccttaggtgcaattgccggcagtttaaaagcaggtgaagctgtgcagttaatcggttttggtacatttaaagttaacgagcgtaaggctcgtaccggtcgtaacccacaaaccggtgcagaaatccaaattgcagcatcaaaagtaccggcatttgtagcaggtaaagcgttaaaagactcggtaaatagctaagttatttttctctatctactttaaacctcgcatttgcgaggttttttgttatcttattttttctctacctctacctctacctttctttctaaatcaaaacgtatttacaattctttttttttatgtaaaattcgaaacgaaatttaaattatggtttttttatgaaacgaaacttttatcctaggaataccgaacagcgtcgtcaagtgataatgcagttactgcaagacaagggagagattagtgttgagcagctagtgcagtattttaatacatctgaagtgactattcgcaaggatcttagtgcattagaaagtactggttttttattacgtaagtacggaggagcagttttaataccgcaagagctattggaagcaaatcacgaagaattactttctaatcgaaagttagctattgcaaaagcagctgcggaacgtattgctgataacaacagaattattatagatagcggtagtacaacagccgcacttattaagcaattaaataataaacaaggcttagttgttatgactaattctttatctgttgcgaatcaattacgatctttggagcatgcacctacattattaatgaccggtggtacatgggataccggatctgaatcatttcaaggcaaagtagctgaacaagtattgtattcttataactttgatcaattatttattggtgcagatggtattgatttagctagaggaacgacaacgtttaatgaacttgttgggttaagtcaggtcatggcagaggttgctcaagaagttattgtcatggtggagtcacaaaaaattggtagaaaaatgcctaatttagaattaacttggcagcaaattgatgtattgattaccgatgagctattgagtgataaagttaaaaagcaaattgaattacttggcgtagaagtagtctgcgtaagtgcggtataaatttttttattttaaggaagtaattatgtgtggaattgtcggtgcagtggcacaacgtgatgtggcaaaaattttaattgatggattatatcgtttggaatatcgagggtatgattctgctggtgttgcaatattaaatgagcaacgtcatgtacaaattgtacgccgagtcggtaaggttcaggcattagatgacgcaattgaaaagcaacagttatctggaggaacgggaattgcacatacacgttgggcaacacatggggagccttcagaaattaatgctcacccacattgttcgggaaaaattgttgttgtacataatggaattatcgaaaattaccaagaattacaagaagttttacaacaacgagggtacatttttcaatctcagacagatacagaagtgattgctcatttagtcgaatgggaattgcgtagtgcaaacactttactggaggcggtacaaaaagcgattgctcaattgcgaggcgcttatggaaccgttgtgatgaaccaagatgagccggagcatttgattgtggcccgttccggcagtccgttagtcattgggttaggtataggagaaaattttttagcttcggatccccttgcattattaaatgtaacacaccgttttatctatctcgaggagggtgatgttgcagaaattacatgccacagcgtggatatttttgattttaatggtaaacaagtagagcgagcagttcataagaataattttgagacagatgtaatagataagggaccttatcgccactatatgcaaaaagaaatttttgagcaaccgcaggcaatcatgaatactttagatgggcgtattttaaatggacaggttaatattgaagctattgcaccgaatgcagaggaaattttacggcaagtagaacatattcaaattgttgcttgcggtacttcttataatgcgggtatggttgctcgttattggtttgaatctattgcgagagtgagttgtaatgtggaaattgcctctgagtttcgctatcgtaagtctgtcaccagaccaaatagtttatttattacgctttctcaatcgggtgaaacagctgatacattagctgcattgcgtttagcaaaacaatccggatatatgtcagtcatgactatttgcaatatagccagttcatcacttgttagagagtctgattttgcctttatgacacgtgcaggggttgaaattggagttgcctcgacaaaagcgtttacaacacaattaacttgtttactcttattaaatgtagcacttggtcgtattaaaggatctattaatgtagaacaggaacgtcatatcattcaatccttgcaacgtttacctgctcaaattgagagtgcgttggtttttgataaacaaattcaaaaattatcagaagattttgcagaaaagcaccatactttatttttaggacgaggtgagtattatccgatagcgatggaatctgcgttaaaattaaaagaaatttcttatattcatgcagaggcttatgccgcaggtgaattgaaacacggacctttagcattaattgacggcgacatgccggttattgttgttgcaccggaaaatgatttgttggaaaaggtgaaatctaatattgaagaagtgcgtgctcgtggcgggcgattatacatttttgctgatcatgagttcggttttagtaatagcgatagttttaaaacgttggtattaccaaaagttgatgctatcacagcaccaattttttatacggtacctttgcaattgttgtcttactatattgctttaattaaaggcactgatgtggatcaaccccgtaatttggcaaaagcagttacagttgaataaaaaatagtaaaagtgcggtaaaatttaccgcactttggttatttgattcaagttgctaccgtaaacagctattaccagccttttgcgacaccgtctttaaagtgcttataagcttcttgataaacttcctctgtttgataggcttttacaaagttttgtacttctacgctgtctttattatctttacgagcaacaataatattaacgtatggagaatctttatcttcagtaaagataccatgttctgcactgtttaaaccgacttgacctgcgtaagtattattgacaacagctaaagctacatcatctaacgcacgagcggcaacagaagtatctacttctttaatctctaaatttttcggattttcgataatatccaatgcagtagagaataaatttgtattatcttttaatttaattaatccttgtttttctaataaaatcaacgcacgagccaaattgcttggatcgttaggtacagcaactatatcaccatcttttaattcgctgatattcttaatttttttagaatagccggcaagcggataaacaaaggtgttacctacaatttctaaattagtgatatttttagattgtgtatctttatctaaataaggtttatgttgcatcgcattaatgtctaaatcaccttttgataccgcagcgttaggtaacgcataatcattaaatacgacaaattccactgctaagttatatttttctttagcaatttgagctgccttttctgccacttgatgttcaggacctgccattacgccgactttaatttttgccggtttgttttgatttgctactgtttctgtttttttatcatcgttacaagctgtcaaggcaacagttgaagcaatggcaatagttgcgaaaagtttgtttaatttcataagatttcctcttaaatagttgtgtttaaaataaattagcgatgatcaacttttttagctaaatcatcccctagtttttggctaataataacaaataacacgatgataatggttgaaatccaagtgatgaatcccatgccacgatgtactccgtagttaatagctaaacttcctaaaccacctccgccttgggttccagccattgcagtatagccaattagggttacaaaagttaatgtaattccattgataagagagggtagagcctcaggtaaatagaattttgtaataatttgccaattggtagcacccaatgcttttgctgtttctgtcagtccggttggaatttcaaataaggcattgctggttaagcgagcaaaaaatggaattgcagcgacacttaaagaaacaatagcggcattagttcctaatgaggagccaacgatatagcttgttacaggaattaagatcaataacaaaataatataggggatagatcgacctatattaataatgacattgaaaattttattagcattgctattttccagaatttgttttttgcccgttaaaaaggttatgcaaccaataggtaaaccgatgaggactgcgataaacgttgacacaatcgtcatataaacggtttcccaagtagaaagagcaattttgctccacatttccggcgttaattgttgattgaacgtaattagcagattatccaacatagcctaatacctccacacggacgttattttccattaaataaattttagtttgcgtgatggcttcttcctcaccttcaacttcggcaataacaaagccgaattttacctcaccggcgtaatctatttgtgaacttaaaatactgagatcgacgccaaattgtttagatgcttgagataataacggggcatcaacggagcgaccggtaaattcaaatttgataattgggtaagattttgcatgttttggcgttgccgataatttttccatatattcttccggtagattaatatggaaagttgaatgaataaactcttgagcaagaagggttttcggattagagaaaatatctccgacagaaccttgttcaattaattgccctttattaattaccgcaacttgatcgcaaatacgtttcaccacatccatttcgtgtgtaatcagtaaaatagtgatacctaaagtgcggttaatttcttttaataattttaaaatagattgtgttgtagccggatctaatgcactggttgcttcatcgcacagcaataccttaggactgtttgcaagtgcacgagcaatagcaacacgctgtttttgtccgccggataaatttgccggatagacatcttttttatcgtatagtcctactaaatttaaaagagcgtcaactttttgtttaatttgggttttatccgttttctctagttctagcggcagtgcaacgttatcaaagactgtgcgtgagcttaataaattaaagtgctgaaagatcataccaatatgacgacgagcatgaattaactcgttatctgaaagttgagttaaatctgtattatctacaatgacagagcctgaagttggacgctccaataaattaatgcagcgaataagagtactctttcctgctccggaggcaccaattactccacatatttgtccttgaggtacttcaagactgacattatcaagtgcggtcagatttttgcctgaaacattgaacactttactgatattttttagcttaatcatataagcccttttctatatagttaaattaaaattagcttgtattttagacgtctagattgctatgtcaatatttattgaatagatttttataaggatttatcagttattggcgatataataaagaaactttgtttttcatagaggtattatgtatatgaataaagcgatttttttagatcgagacggcacgttaaatatcgatcacggttatgtgcatgaaattgacaaattccagtttatagcaggaagcatagaagcattgaaacaacttaaatctatgggatttttattggttttagtcacaaatcagtccggcattgcaagggggtatttttctgaggaacaatttttacagctcactgaatggatggattggtctcttgcagacagaggcgttgatttagatggtatttactattgtcctcatcacttagaaggaatcggggagtataaacaagattgtgattgtcgtaagcctaaaaatggcatgctactgcaagcaataaaagaattaaacattgatcctgcaagatcttttatggtgggagataagaaagaagaccttttggcggggaaaagtgcggggataaaaaagaatattttggtcagaagcggtaaagaaatcaccgatgacggattgtctttggctgattatgtgttagatactattgctgatttacccgaattaataaaaaaattaaaattttaaccgcactttttattaaaaaattaggctatgtcttaaaataagattgaatgatgaaattcagttttttgcgttctgtttgcataattgctcattctgtatatacagaaagagataacatttctgctatctctaatgcctacaatcatattttttagtttctacctacaacctgttttgttgcctctattttcttatctttccacataacaacatcttttataacaagtttttggacagcagaaataagaagttccatataggaaaagtctatttcgttattttttgttggcagtttaattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctaacgcttctttttcctcactagacaattcataattgtctagtctgcttaccgttaggtaagcggagagttcgcttattcgctcctcttcgagttcgcttataaagctctccataaattcaaaatctattttgttgtcttttgttgggagttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatttacatcaaacaaatctccaattctatactcgccccactgaacattttggagtttttcattcagtgaggcatttatttttttaggcgttcattctccttatctgtatttttaagaagagtggatacttcccaagcaaggtaatcggctacagttttcttaaaatcttcaagtgttggtcttgtatctatcggtgctgattgattccagtctgaaccatttaaagggtcaatatgaccttcgtaatattctttttctgtaaagatgtttaatttttgttttccaaaacgcacaaggtctaccacttcctgatatctttcttttgctctgtctgtatctctaagatttacacttgctttttttctgttcgttcttgtgtagccatcatttgaaaaatcgataaacttaacgacttcatctttttgatgagattcgcctactctaaatacataaatatttgtttgaacacttgattttccaacaaataaatcgatgggcattttaatacttgcaagtagggtattgttttttagaatttttttgtttatttctgttgctttgccacttcctgcagagttttgaatgatgattgctgcatagcccttgttcatcatagacagggctttttctacgaaaatcattccattgccctctgctgaataaggcggatttaacacaaaagcagtagctggaaatttctcatctgttttaccaaatccatatttaccgtcaaaatcatgtagtgagtctttgtttaaaatgtttgaggwtccatctcccataagtatcatatttaaaatggcaagcatatagatgttggatagaacttctaagcctaaaagctgttctgcttttatctttagttgtttttgctctagctcaagtggtgatgtgatttttgcttttgcatctataatcatctcgttcattgcagcaacaagtagccccgcacttcccgttgcaaaatcccacacatagctgtctttatcaactcttgcaagttttactaaaaaagttgctacataagatggggttaaaacaacatcgtttaatttgtcttgcgtaaagccgagccaagagtacatttcattaaaaagcttacctgtaaagtctgtagttaagcctattttgtagtaaatacctaaatcgtctacgatttttgaaaatattctttttaattggctttctccgtttattggcttattaatattttctgataataatgtattttttagtgttcttacgataaggtcttgttttgtttttggtaggtttttcttttttaaaaacgcttctatttttctaacgataatttcgccgtctgtgtttccctcttctattgatgattttaggtcagacttttctagtggacttacccccccccggtattcctagtgttgccataatagaagctgacacaagatagactctgtcgttttcactaagccctttttcatttgcgtaaatatcattgtttagctttactaaacttgcatttatttctttttcacgtttttctttaagtacttcaagctcctcagcagataaagaaagttcgtttacttttttaataaaatctgtaaagttttcttttcttaaaaatgaaaggtctgtgtattttcctacttcttgccctatcccaaaattatcttttgatacatagtaaacgccaatagagtgttctatttccccgttttcttttttatatcccgtaacgccgattgctattacatttgtgtagcttgtgtagtgaagtatggcattggcataatgaaccgctccatttacagcatagctattaatatttttgtaattaggctcgtttttacttgttctattgtcaactctaccgtcaatgtctaactttactaatttatctttatatcctttatattctatcagtattggataatagttaagtgcctcatcttgcaataaaagttttgcatccggtctatttccacccgttccgccactttttgatttatattcatcaagtgccttatctatttgtgcatttagactttcttgttctaatttataatccagcccataacttttaagccacccatttacaaggtcaactatgtttggttctatagattgcattttaaccattgtctattctcccttttcaacatattcatcatcaaaagaaaatccatcgttcggcgtgcagtcaaatgccttgaatattctctctaaatttttaagcgttatcggtttatttttcccatttttgccataatattggttgttaaatctgacattgttataacatcaattttccttaagcctgtcaatcgtattttagaatgcaaccaaaaattatcttaaaaacccttaataataagggctttgggtgagagagtttttaatgagaacgttgtactagcaagtgcattctggcgatattttgagcggtagattctagattttgtctgccttgagccaaaatttcaggcaaactgtctaattgacgaataatggggaatactgcatcaatgccatgctcatagactacttcataatcttcccgtaagcagcctgtaatggctataacaggtttatttgccagtttggcagtttttgctactccaataggcgttttgccgtgaatagtttgtgaatccattctaccttctccggtaatgaccaaatcggcatccttgataatttctgctaaatttactgtatcaatgacaatctgcacaccggatttgagttgtacttgaggcaataatagcaatccaccacccataccgcctgcagcacccgatccgggacgctcagcaatccgttttccgcaatctcgttctacaatacggctaaaatgcagtagagcttggtccaattgttgcaccatttccggtgttgctcctttttgtggaccgaaagtagcagaagcacctttttcaccatataaaggattatttacgtcgcaagctacattaaattgaacttgtgtcaaacgttgatctaaatgtgcagtgtcgatatgagcgatttgttgcagagctagaccgccaaagccgatttcttttccttgagcgtctttgaatttgatacccaaggcttgtagcataccgacaccaccgtcattggttgcactgccaccgatacccaaaataatttggctcacccctagattcaaggcggcgttaattagttctcctgtaccatagcttgtggtgtagtaaggattgcgtttttctatcggcaccaaatgtaaaccggaagccgccgccatttcaataattgcgatttttccatcacccgatatggcaaattcagcttgcgttttattacctagaggtgcggtaacctctacagaaatcagtttgccttgtagtgcatcggcaagagattggactgtgccttctcctccatctgccatgggaacttttacataatctgcattggggtagatttttttgaaaccattttcaatagcttgagccacttcaagtgcggttaaactttctttaaaagaatccggtgcaatgacaattttcattttagttctccttgatagtgattgattaaaataattgccatacaccaaaaatcagagtagagataattgtcatgatcaaacctactgcagtttcgtatgggattagttttaaccgctctttaatatccatattaacactaccgccggttgcatgaaagaaagaaccatgaggcatatgatcgaagacggttgcaccggcatgaatcattgcagccgctgcgataccgctgacgctcagttcaattaaagttgctccgaacacttgagacgctacagcggttcctgctgtagtggaagctgtggctaatgacattaatcccccggaaatcggtgctaatagataagaaggtagtccggacgcagttaacccttcaattaagagttcttttaattcggaattagcgattacaccggctaatgttccggtacctaacaacatcacagcaacaggtgccattttacctaatcctatcactgcatattgatttaagtaacgtgttttattcatgcaaattgtgcctacaataccgccaagaggcagtgcgattaaaggatcaatttttatgccgaataatgggcgaagggcaagtaaaataatagtaaagagcggtgcaataattgctggcaagaattttggtaattcgccggtgatcccaacgatttctttttcacttacttttgagcctttattcattaggcttttggctaggaaataggtgataattagaccaaaaacggcaggaatgatacccgctgtcatcactgaagttagagggatgttgaaggcatctgatgcagcgatagcatttgggttaggagacataatattacctgctttaccacccccaatcatggctaacaaaatagccattttggataaattgctacgttttgccaatgccagtgcaatgggggcaactgtgatgactgcaacgtcaataaatacacctacagccgttaataacattgtggcaagaatgagtgccaacaatgatctggattcacccagtttttttacgatagtatcggcaatagtacttgccgcaccggattcaattaatacacctgccagcacaccagcggctaaaatcctcataacagcggtagtgataccttgtgctccgcctatcatcagcgtaactgtttggcttagatccgcacctccgattaaacctcccacaagtgcaccaataatcatgccataagcaggtgggacttttttcaaaatgagtacaattgcagtaaaaagggcaataattgccccgagagcagttacagttatcatgatcgtttcctcatatattaataaaaaatcatgttgtgtattattgaatgtatgaggttaaaaaatcttcatacataaatacaaaaatacctgataaataggattattttttgtatatttatacaatttattggtttagtaatgtgcttaggtagagtgtaaatttttcatctatcttattgaaagacaagccggttattttctcaatcttgcttagacgataccttaatgtattgatatgaataaataattgttgtgaagtgagagcaagatcacaatttgaaaaaaaatactgttgcaatgttttttgtaacagatgattttcgtcttgttgatataaggtatcaataggttttaataactccttactttgccaagtactacgtaagttatctaataacgcaggcaatttatattgattaaagaaatagatggatttcttaggaaaataagtttccccataacgaagggtactaagtgcggtctgaaatgaaagtgaaatgttgcgattattttcaacttcggaaccgatagccactttcagcccttttaatcccgaaggtaatagataaggaggaaataatttctgtaatccttttgtaccaagtaaggcttgaagttcttcagtcggttgtataagtgcgattttatcatgcgataagattgcgaagtggttaatcgattgttctaaatatccagcaagcttttgaagtttctctgctgtggggtgcaaaatttggataataatgaccgcacttttagtatgtagcgttagtccgaaaaaagcactttgtttctcaatttctgcctcgttgagtttaccttttaataaacctagaacaaactcttctttataacgtttatcccaacgttctttttctaacaaaaagtgttgttcaatcatcaattcagcagtcattttaaccatttcaccataggatcgaacagtgtcgggatctccggaaatacctacaacacctaaaatttctcccaaataactaatgggaagattaatacccggttgcacttcaaataaccatttttcagctaactcctgagttatttctatagtttggttgtgacgaatagagtatatggcaccaatatgtctttgttgcaaacggtgaggattacttgaggcaataataatgccggtttcattcatcacattgataggcttatgtagaacacggtttgttcgttgcacaatattttgagctaaagaaacgcttaatttcatgttcatagcaggacatttactgtaattatcaatagagtgactttcattttatgagaattttagacaaggtaaaagtataaaatttcagcaattaaaaaatttttttaaaaaattacttgcattgaaatataaaatgcctataatgcacggcacacaacgacacgctgttgtgagatgttaagcagtgtgtcgttattttttgttctttaacaaactatcagacaaactgtgtgggcacttgtgaaactgtattaataagagattaaaagagtaagataagtgcttaaactagagaaattcatagagaaaagatggatgaaatagtcagtatttattgagcgaagagattaaattgaagagtttgatcatggctcagattgaacgctggcggcaggcttaacacatgcaagtcgaacggtaacggggagggaggttactttctctgctgacgagtggcggacgggtgagtaaagcttgggaatctggcgaatggagggggatagccacgggaaactgtgggtaataccgcgtaatgtctaaggactaaaggggtgggactgtgaggccacctgccatttgatgagcccaagtgggattaggtagttggtgaggtaagggctcaccaagctgacgatctctagctggtctgagaggatggccagccacactggaactgagacacggtccagactcctacgggaggcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagataggtggggtgtgtaagtgtagtgatatattgagctaacccatactaatttcccgaggggcttaaccatacaatcttgagtgttttgcatagaggaagaagcgggacaggatagagagaggaagacttgaagtagaggcttgtttttttattgaagaagagatagagacgggatataagagagaggaatttaacttggcggcgatagtgcggtgggaccacctgacaccatgccgaactcagaagtgaaacgctgtaacgccgatggtagtgtggggattccccatgtgagagtagggcaccgccaagttttttatgatatgaccctgagtggagacactcagggttttttgttatttgggataaggcggggaagagagaagagggaagaggaaaatgggagaaaaaaagtaataaggtgataacaaggtagttataaaaagtagggtaatgaagcagcgtgaagaggtgcggtaggaaaattgtttttttttctaccgctctttttttaggtaatttatttatcgtttgccttattcatacgtccggcaaacaatatctttttcttcacaaaacatctcactatgctgtgcttgacactgtctttgtacattaagtttagctcggcctctgttgctatgctcactgcgatattcttgagtaaatggttttaatgtacaaacatgaatagcatcaaaatcagtttgttccgaaacaccgatgaaaattggaactggaatggctgtttgatcttttgttgatgtcggtacaacgcaacttgttaataatatacacaaaccgattaaacaaaaacgcatatttttctcctaaaaataaccttaatttcaaattttaagacgattttattatactcaatttttacaagaatgttcagagaaatgacaaaacatatagttttactttttctccataaaaatgtaggcatgatgtaattgaaactaagttgtatctcgtgtttaattaacattcatgccgatatcgaaaacatataagcaatatttgcttcgtttgttacaaattatttttcaattcgtaatccataagatttaaatttctctaatacaatctccatttcttttggagttaacaatgggatttctaaacctgtcgctaaaagtttcatgtaccattgtgccaagacttcaacttcatgagcaagccatagtgctttatcaagatttttctctgcagcaattaaaccgtgatgtgctaataaaattgctttacattttttaataccttgttttacatgctcagctaattcatgtgtaccaaaagttgcataaggaacacaaggaatatgatcagcaccgcctacggcaatcatgtaatgaaaaggaggaatgggtttttctaaaatagagacagctgcacaattgattgaatgattatgtacaactgcatcaacatcaggacgtgcttcatacacagctagatggaaatgccattcactggaggggaatttgccttcttcatgtttgccatgtttatctacataaacaatgttgttttcagtcagcaattcatatggcatgcctgtaggagtaattaacataccgtctttatatctgacactgacgttacccgcagttccttggtttaaaccaagtcttgtcatttctaaacaggtgaagataattttttttgaaagtagtgatctatccatttttattgtccttctatttcacaggtgtaacaccttttttaataataatattgccgtattttgcagtttcaccggtaataactactgcataagcctgttttgctcgctcataaaaagcaaaacgatccattcttgctaatttaggcacattacctaccgcacttttaattgtttgaagatagctttgctccacagcgggatccaaactatccccttccactgcttgcatcataattaacggtgcctcagtataagtatcaaactcaaataaaggggtaatacctgtcagtaaagaattgatactaataccgtcagcacgaacaactttatgatgcaattgatgagctggaaaatgagcatcagataaaactaactcatctccatgtcccatttctgctaaaattttcaacaaatccggtgaaattgccggatgaatcccttttaacatatatcctcctgaagttttttataaaattccatatctgttgaaggctcaattcgtcggaatgtcggcttcattttttgctgtgcctcttcgacgtttgcaaaaacgcccgcaccggttaaagtaaacatagctgcacccaatactgtactctctgctatatcaataacatcaatagggcaacctaagacatcagcacgaatttggttccaaagtttatttttagatccaccgccaaccacaatcaaacgatccgcactaaaatttcccactttttgtaatacattcaagcctgcttttagacggtaagccatgtattccaaacctgcacgataaatttcgccacgtttcgtatgcattgataaacctttgatttcacctgtttgttccattttgccgtcaaaatttcctacgagcttcacgccattggaaccggcaggtactgtttcgccctctgcgatcatagtttgataatattgctctttggttacatcggaaaagaattgtttgcccaaccattcaatcacacccgaactaacccattgcactcccggattaaaagcaccaggcagactatcaaattctatggttaaaccatctctgacatattgccattgtgcttgagcttgctgtgttcttaccattaaaatttcccaagtgcctgaactcaaaacaggttggttatatccggcaccggaaccgaaaatagcaaattgagtgtcatgtccacaggaaagtactgggatatgtgttgataaacctaaatattttgctacctcaggtaataaattacctattttttcacccgctcttttcatcggtgggaaatgttgttcattcaaacctagaaaatctaaaacctctttatcccaagagtcattttctatatttgtcatcattgatgtacctgccatagtacgatctgtactaaattgacctgtcaaacgttgagttaatatagatgaaatgaatacccacttatccatctcggcaaaaatatccggtttattttctttcaaccacaataatttgaacaatgtattgaaactatattgtccaataccattacgctgatagagcttttttacatcaaggtattgatgaagtttctccatgacaggcaaagtgcggggacatttccaagaaattattggaaaaatttgcttcctatttttcgaaaaaggagcaccatctacaccaaaggtagtaataccaatccctttaatttcagctaaatcaatttgtttttggcgtagattcacaattgttttttctgcacaaaaaataagtttttggtagatttcttcgatgtcccaaatatgataaagagagttttcaggatcaggttgagtgtgattaggtgtatgatgtgatgcaacgattttacctgcttcatttattgcaatggtacgtaaatttgttgcaccacaatcaaaaatcaatgcaattgccataataactccataaaatcatgagcttattgcttaattaagaggggaaatttagtccttccccctccccttggatttcataaattaacgatataaaggaccaaagtttgcacaagcacggtaatcttgaccttctttatcttgaccaaatgcactccaagcacttggacggaaaatgtctttttcttcgacattgtgcatacagactggaatacgtagcatggaagcaagagtgatcaaatcagcaccaacatgtccataagttgcaacgcaatggtttgccccccaatttgccatgacagaataagcgtcagtaaatgctcctgtacccgttaaacgtggaacaaaccaagtagttggccatgtttgatcagtacgtttatttaaaatatcatgcacgttttctggtaaagcaatagaccatccttcggcgatttgtaaaacaggcccaatacctttgactaagttaattctatgtatggtaaatggcatcccgcctttagttaaaaattgtgacgataaaccgcctcctctgaaatattcgtgtaccgccggacaccaacgagtattttctaagcaacgctttccatcttcttctgttacttcccataccggtttaatgactgatgttccgtttggatctgtatgttgtcccgtaccatccaaagcggcagagccggaattgagtaaatgaataaatccactttcaggacgccaacctgttacacgctcaacagaatcttcactccaataggtacgtacatcagcaaaaatttgagcctgagcggttagcaaattgccgaataacatgttaacgccatttaatgaatcattttctgtggctaaaatataaggaggacgtacaccgttccagtcataagttgaattcaatattgcttccataaagtcgccgttcggtagatgatctgtccaatggcgttgaccttggaaaccagcaccaatcgcattatgtcccattgattcttctacataaccaagttcagctaaacgaggattaccaaccattagatctcgacaaataatcgtcattttgacaacattttcccaaagttttgctcgttcttccgaactacgctgattttctttagcatttacatcaataccttctttacagtattgagtgacccattccatcgctaatttaacttctttttcatcatagattttgcgatctaaacggcgtttaatttcggtcatatctacatattcattacgcatatccaaatattcttgaaagaatgcttgattaacgatagaaccggcaatacccatagaaactgaacctatagataagtaagatttaccacgtaaagtcgcaactgcgagaccggcacgagcaaaacgcagtaatttctctttaacatctgttggaattgttgtatcagatgcttcttgaacttcagtaccgtaaatagagaatgcaggtagccccatttggttatgtccggcaagagccgctgccaaatacaccgcaccgggacgttctgtaccgttaaagccccaaattgcttttggcatatggggatccatatcgattgtttcagaaccatagcaccagcaaggggttacagtgatgactgcaccgacattttcacgtttgaatttttcagcacatgcagcagcttcagcgacaccaccaatcgtggtgtccgcaattacacatttcacaaattgcccatttgtgtgccgcacttccgtttcaattaattgagccaccgcttttgccatattcatggtttgatcttctaaagattcacgaacgcccatacgacgtccatcaatagttggacggataccgatttttaccggtgttgattttaaatgtgtcattttttattccttcttgatgattaagtttattttttcacaaaaaacaacagaacatagttttttgtgtaatttgtaaaattttcgtgagataaatcacaaaaaaatccttttttgggttaaatttcttgtttttatttgcccgatttttaaatgattcatgatttttcgggcaaaacgatcaaatcaggcttcgaattatttcaataccttccaacttctatagccataaatagtaattggaataaagcagattaatggcagaacaaaagaaatgttcacagcaggcaaattaaaaatttcacctttatcaatgatcatgccttgtaaaggtggcattaatgcaccgcctacgattgccataaccagacctgcggcaccaagacttgcctcttcttttaaaccgtataaggcaataccgtagattgttgggaacataagagacataaaacctgaggttaaaattaagcaatataatcctaattctccatcgataaaaattacgcctacaatgcttaagaaaccgccgataccaaataggcataacatcaactcagcttttaagtatttcataatactggtgctgataaagcgactggcaacaaaaattatcattgcaataatattaaaattttgtgcttcagatttagtaaaacctaagcgttcggcatattggataataaaggtccagcacataatttgaacacctacatagaaaacctgagcaattacaccttcacgatactttgcattttggattaggcgagaaaatgcgtctttgaatgcaattcttccccccccccctagctcttccatttttgtagtaggcattttgtataaactaatgactaacatgatgattaaaacaacacctccaacagctaaataaggattacgaataatttctaaatcatgggtgcgtatagtcgctttttctgcggtagataaggtattaaaaattagatttcccattgcatcacgtttttcagattctaggctggttaatactacttgtgatgccacaaacatacctgtaatcgaacccaacgggttaaaagattgtgctaaatttaaacggcgggttgcggtttgcggatctcccatcgaaagaatatatgggttggctgtggtttctaaaaaagctaacccaaaagtcagaatataaagtgatagtaagaaaaaagtaaattcttcatacaaagctgccggatagaataagaatgcaccaactgcataaagggctaaacctaataagacaccggatttataattaaatcggctgacaaaaagtgcggctggaattgccattgttccatagcctccataaaaggcaaattgaacaagagcagcttctgatgctggaatttccataacagtttggaaaacggctaccattggattcgtaatatcatttgcaaatccccacaaagcaaacaaactggtaattaatataaaaggtgcaataaattgcttttcaagagttttagctgtcatttttctttccttaattatgagagtagtttcaaggattacattctcgtaaaattatgctgcgtgctttgcatcattttttgaaagaatgttaaaactattagaaaggaaaaatagaaagacaataagaaatttatgaaagtagttaaatttctgtgaaattcatcacaaaaaacgctaaaaaaattaaaagataatgcccgaattaaatcaattcttttgtaaatcgggcattattttgtttggataaagaggctttaaacaatagtgattaaaacatcagatttttggcagtatgatgtcaaagttggatttggaacttggtctgtaaataaaatatctatttgtgataaatctgttaaacgaatcaaatttctacgttcaaacttagaactgtctaataagagaaatttctgttcacaagcatccattaatttacgtttaattgaggcattaagctcatttgattcccaaactccaccgctactatcaatgccggtgcaagagaaaatcccaatatcaatatgtaaacgttgtaataattgttcggataacggtccataaaaagcatcatatttcactgaataaacgccacccgttgcaatggttttaatattaggtttattaacaagtgcggtaatgttatgcatagaattggtcactactgtgcaaggaatatcggggatcatttgtgcaaaatgccagctggttgaactggcatccaaaccaagtacaataccttcaaacatatattcaatggcggaagcggctatggcacgttttttatcgcaattaaagcgttgtcggctttgaaaagaactcccgacatctttcgctttacgactgacagcacctccatgtacacgatgaattaaccctctcttatccagatcggttagatctcttcgaatagtttccacagatacgtcaaattgtttagctaaatcatttacattcacttttccggatgaatttattaattgcaaaatcaatgtttctcttgatgacatttcttttctccaagcagtcaagatggttacgaaagattacacgctaaacgatagtaagatcaactgttgaaaaattaccgcactttgccttaaatttattttactgtcattggtagtgttaatatgttcaagaagaattgcgtcagatcaggaaaagctgacttttcactttaaaatatactcattttttgctataaagtcggcagttttttacttaatacttaggagatattttatggagttagtatttattcgccatggttttagtgagtggaatgccaaaaacttgtttaccggctggcgtgatgtgaatttaacagaacgtggtattgaagaagctaaagcagcaggtaaaaaattacttgaagctggttatgaatttgatattgcatttacctcagttttaactcgggcaattaaaacctgcaatatcgtgttagaagaatctaaccaattatggattcctcaagtgaagcactggcgtttaaatgagcgtcattacggtgctttacaagggttggataaaaaagcaactgctgaacagtatggtgatgaacaagttcacatttggcgtcgttcttatgatgtttctccaccggatttagatccgcaagatccgaattctgcacataacgaccgccgttatgctcttttacctaaagacgttgtgccaaatgctgagaacttaaaaatcactcttgaacgtgttctgccattctgggaagatcaaattgcacccgcacttctttccggtaaacgtgtacttgtcactgcacacggtaactctttacgtgcattagcaaaacacattatcggtatttctgatgaagaaattatggcttttgaaattccaactggtcagccgttagtgttaaaactggatgaacagttaaattttgttgagaaattctatctataatttctttatatacctaatcaatggctgagggtatctcagcctttttgtatcactttttacattgatttgattttatcttgtcgcaattcctctttaatttctgtacaatcggcagattttgtgtttattgagatattctatgagttcatccccaaatattggctttatcagccttggttgccccaaaaatttagttgattctgagcgtattctgacagagttacgttctgatggttataatattatttccagttatgaaggggcggatttagttattgtcaatacctgtggctttattgatagtgcggtgcaggaatcattggaatctatcggagaagctttagagaataacggtaaagtgattgtaactggttgtttaggggcgaaagagaaccaaattcgtgaaattcatccgcaggtgctggagatcacaggtccgcatagctatgaagccgtgatgaaacatgtgcataaatatgtacctaaacctgaatacagtccttatactagtcttgtgccgaaacaagggataaaactgacgccaaaacattatgcttatttaaaaatttcggaaggttgtgatcatcgttgtactttttgtatcatcccttctatgcgaggtgatttagatagccgctccattgtgcatatactcgatgaagccaaacgccttgtagatgctggtgtgaaagagattttggtagtatctcaagatacctctgcttatgccttggataagaagaaagaaaatgccagtaaaacggtattctggaatgggatgccgattaaaaatgatctgattactttatgtgaaaaattaggttcgctcggtgcgtgggtgcggttgcattatgtttatccttatccgcacgtagacaatctcattccattgatggcagaaggtaaaatcttgccttatttggatatccccttacaacatgccagtcctaaaattttaaagatgatgaaacgcccgggttcaattgaacgtactttagagcgtatcaaaaaatggcgtgaaatttgtcctgatttaactttgcgttctacctttattgttggttttccgggagaaacggaggaagatttccagttattattggatttcttgcaagaagcacaacttgatcgtgttggttgttttaaattcagtcctgttgaaggtgcggtcgccaccgatatggaagatcaaataccggaagaaatcaaagaggaacggtttcaccgttttatgcagttgcaacaaaaaatttccgctgaacgtttacggcaaaaaattggtagaacattacctgtcattattgatgagattgacgaagaaggcattattggtcgtacgatggcagatgcaccggaaattgatggcgttgtttacgtagataatttttcaaaagtggaagtaaaactcggacaaattattaatgtaactattaccaacgcagatgaatatgatttatggggagagatttaagtgccgttaagtgcggggtgaattaccggaatatttattctccctcagaagcagtgatatattataaaattcaatttccaggatatgtatcatgttatttttacgacaaaaattcaaaaatagattaaaacttaccgcacttttttatgtagtttatttgcttttttcgtttgttgctcgtgccaatgaacttactcgcctccaagaaaaaattaagttacaagaacaaaaaattgcacaacaaaaaaatgaacaaaatgaattacaaaacgtattaaaaaaccaagaaaataaaattagtcaagcggaagataaattacgtcaaacagaagaaaatttgaaagaaacacaacaacttatcaatacaacagataaacagataaaacgcttggaaatgcagctcaaaagtcaaaaaaaactgcttgcagagcaaatagataaaatgtaccgagctgagattaattcttccgcagttgaaaagttgttttctcaagaggcacaaaaatctgaacgtatgcagatttattatcgtcagatgaatcaaactcgtttaaagttgattaatgaaatccaacaaactcaagaacagctggagaatgaaaaagcccttattcaaggaaaaagaaaaaatcagcaaaatcagctgacaacacaaaaacaacaacgacaagaactacaaaaattacagcgtgagcaacaattaatgcttgaacagctgaatcaaaatttagtaaaagatcaaaataagttggagcaattaaaggcaaatgaaattactttgcgtcaacaaattcagcgagcggagaaaattactaaagagaaggaacagcgagagcgggcagcattggcacggaaaaaagagtcggaagaaaggaaaaaccgaaaaccttataaaccgacagcacaagaaaagcaacttatggcaagtaaaaaaggtttaggtgttgcaaaaaaacagtattcttttcctgtacagggtaaagttgtacaaggtttcggtacaagtcaaatgggagaattgaaatggaagggtatggtaatttctgcggtaaaaggttctccggtaaaagtaattacagatggacgggttattttagtcagtcgtcttgcaggttatggtttaatggtaatcgttaaacatggagagtatgatctcaccctgtacggttacaatcaatctgctatggttgaagaaggacaatttgtgaaagccggacaaaaaattgctgaggttggtgatacggggagttatgcacttccggcactttattttgagattcgtcgtaaagggatacccgttaacccgatgggttgggtaaaataaaatgagaagaaatatatgtattaaaagtgcggttaaaatcagtcttatggggctaatcctgagcattgtatcgtcttttatttatgctcaacataaactggcgattgtaattgatgatattggatatcgtcttaaggaagataatcagatttattctctgccaaaagaagtttctgttgccattattccttccgcacctcatgccaagcaacgtgatcaacaggcaaaacaacaagatagagatattttaattcatttgcctatgcaaccgcttaatctgcaaaaaattgaagacggtggaataaaattaggtatgtcgcaaccggaagtttatcatcgagtaagaaatgccaaaagtattttacccaatgctataggtatgaataatcacatgggaagtgcggcgacagcggataaagatttaatgaacaaattaatgaccgcacttttgcaacaagatttattctttcttgatagccgaaccattgggcgatcagttgcggggaaaatagcgagagagtttggtatacccactttggaacgtcatatttttcttgatgatagtgataaacttagtgatgttcaacgccaatggaatgcagccattcaatatgctcgtaaacggggaacggctattgtgattggacatccgagaaaaaatacgattgcagttttgcaaatggggataaaacaattaccaaaagatattcaattagtgggtattggcagtttgtggcgtaatgagaagataattcctcagaaaccttttatttatctgtttaatgatatacccgcaccgacatcgcaagcaccatttcaaactattcctttgttaagaggagtaccgaccgatatataacagaaaatacatgattaaagaataaacctctgaaggattttcagaggttggaagtcaagggcgaatgtcccgtaaaatgggattttgcatagaaatcaacgtttctgtggattgaatttcatcgattagttgaatttttgtcgcaagaactgaatgaagctcagcaatagtatgggtcattactttaataaagatagaatagttaccggtcgtatagtacgcttcaacgacttcattgatattctctaattgtttgataactttgtcgtagtctttcgcactttttaaaataataccgataaagcaacatacatcataacctaatttacgttcatcaatgcggatttttgtgccttgaatgatgccggattgacgcattttttctactcgcacatggatagtgccaggactgacaccgaaatttttcgccatttctgcataaggtgtacgtgcatctttgattaatactcgtaagatttgttgatctaattggtctaaatttggcatatttatttttccttattgtttagaattagaaaatatataaaaatattatgctatttttaatataaattcaatattaataaaaaaataaataaatggtattgaattagtggtatattttattaaataatacttaacgtgaatttaatattcaattactcgttattaattattaggatgtatgtcatgaaaaaatcatttattttacaacaacaagaaattagttttgctaaaaacacttttacagaaaaattaatcgaacatttaggcatcattgaagtgcaaggacctatcttaagtcaagtgggaaatggtattcaagataatctttcaggtacagagaaagcggttcaagtaaatgtgaaacagatcactgatgccaaatttgaagtggtgcattcattggcaaaatggaaacgtcatacattagctcgttttaactttgcagagaatgaaggcttatttgtacatatgaaagcattacgtcccgatgaagatagtctggatcaaacccactctgtttatgttgatcaatgggattgggaaaaagttattccaacgggacgtcgcaaccttgcttatttaaaagaaactgtacgttcaatttatcaagctattttggaaacggaagaagcagtacaccaaaaatttgggttgagtaaatttttacctagagagattacttttatacacagtgaggaacttgttcaacgttatcctgaattgaacgataaacaacgtgaaaatgcgatttgcaaagaatatggtgcagtattcttaataggaattgggggagtattatcagatggcaaaccacatgataagcgtgcacctgattatgatgactggacaacaccgtctgaaggtgagtatttaggtttgaatggtgatattcttgtttggaatcctgtattggagcgtgcatttgaagtatcttctatgggcattcgtgtagatgaaaccgcattacgtaaacaactggcattaaccggtgatgaagatcggttgcaatttgactggcatcaagatcttgtcaacggacgtttaccgctttctattggtggtgggattggtcaatctcgcttggcgatgttgcttttacagaaaaaacatattggcgaagtgcaatcaagtgtttggccaaaagttgttacagaacagtttgaaaacattctgtagcgtgcttttgaatattatattgaaaaagtgcggtaaaaataccgcacttttttatatcaaagccaaaatgttcttgatagaatacccattcacctatttttaacgaaatctagtttatgtatagctcattttcttctttatttgaacaagttttgcaatctcccgattttatcattttaataaaaatgtctgttgctatgctattgggtggagcaattggcttagagcgagaattgaaacataaaccggttggagtaaaaacttgcgtaattatttcggttacaacttgtattctaacgattgtttcaattaaagctgcggaacattatgcacaagtttcagaaaatattcgaactgatccaatgcgtttagctgcacaggtcattagcggcatcggttttttaggtgcgggggtaattttacgtaaaagtaacgatgctatttcaggattgacaactgctgctattatttgggcagctgctggtattggtattgttgctggagccggcttcttttttgatgcttcagttgctacatttatgattttaatcgcagttcgggtaggtccgacgttacaacaaattatccgtcgcagtacacgtagaacacgtaaaactaaaatttatattcaacttagttcaccattgatcatcagtaaagttacggatattttaattaataataattaccgaattgatagtttatctgtcaaagatttacaaaatggagaagtacgtttaaccattagaggattaatcacagataaatcgaaagtacaaggcgtttatttgttactaaaagatgaagaaggcgttgtcagtattgatttggctaattaaaagaaaaatccagatatttaattgatttgctccaaaagttgtactacatacaccatcaacaaattaaggggcagattttttatgatcaaagggaatatctccttaaaaattttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaattttatccttttcacttgagctttatttttaatctctgtataatcgccaaccttacagccatagttaattttcgttccttgcttccgcaagattggtggctggtcttataatcggaggctgattaacccgtaaggagcagtaatgcgtcactacgaaatcgtatttatggttcatccggaccaaagcgaacaagtacccggcatgattgaacgttatacttcttctatcaaagaagccggcggtcaaattcatcgcttagaagattggggtcgtcgccaattagcgtacccaatcaataaattacacaaagcacattatgtgctaatgaatgtagaagcgcctcaagaagtcatcgacgagctagaaacaactttccgttacaacgacgcagttcttcgtaacgtaattattcgtactaagcacgccgtaacagaagcgtccccaatggttaaagcacgtgaagagcgtaagcctttaactgaagttgaaaacaacgattttgaggatgctgaagagtaatttagaggttgataatcgtttttcgttaattggcaaagttgctgattttccaaaacgaaacaagagcccaaatggaattgatcattgccttttctatttggaacatcgttcaaataagaaagaagcaggttttacccgtcaagcatggtgtaaaatagccatccaaattagtggcaatcaattaatagagaaaactcaaagcattacggtcggtcagcaattattagttgtaggttttgttacttcgcatagaagttcaaatggtttaaatcaattaatattgcatgccgagcaaatcgaatttatagagtaggagactagccaaatggcacgttatttccgtcgtcgtaagttctgccgttttacagcggaaaatgtagtagaaatcgactataaagatattgctacattgaagaactatatcacagagagcggcaaaattgttccaagccgtattaccggtactcgtgcgaagtatcaacgtcaattagctcgtgctatcaaacgtgctcgctatttagcgttacttccatacactgacaatcatcagtaatttaaggagaatacggtaatgcaagtaattcttttagataaaattgctcatctcggtaacgtaggtgatcaagttagcgttaaagcaggttttgctcgtaacttcttaattccacaaggtaaagcagttatggcaactcaagctaatattgaatattttgaaagtcgtcgtgctgaattagaacgtaaagcagcagaagttctagctacagcacaagctcgtgctaatcagttagcagaattggcaactgttactattacatctaaagccggtgatgaaggtcgtttattcggttctatcaccgcacgtgatgtggctgaagcagtaactgcggcaggtgttgaaatcgctaaaagtgaagttcgcctttcaacaggaccacttcgcacaaccggcgaacaccaagtccgtttccaattacacggcgaagtatttgcaacattaaatgttgttattgttgcagagtaatcattaaaattataatgacagaacccaacttttatgttgggtttttttatatctttgttgccccaagtaatcttatagctaaattctttaactcatacattaatccacgtatttttctaacataacattattcatttctattttttatcctttatcctttatcctttatcctttgacaaccttagtagctttaattcaattataataacgcactgttttcttactaactctttgagaaatagtaatctccgataattcctgtaatgatcatgggcttattgtaatctctgctgttgtgtatgggatattttaaaatctaaataatccgatacggtgtgccgtttcttttttgggtataatctgtcaatcttcttttactaaaggagattattgatgagtaaatcaaaagtaatattaatccgatatatatggtgctacaataagtgcggtgcatggtgcatggtgcatggtgcatggtgcatggtgcatggtgcatgctttgatataatatattttgagtgaggaatttgcgatgtcctatttagaacgtgcaagagagctttttgatgaagcaaaagcagtgagaagacaaatccatcaacaccctgaagtgggttttgagttgcccgataccatggcgttgattaagaaaaaattggatgaacataatattcagtatcgtcaattggacgatgcctatgctctagtggggacgttgggcgatccgagcaagggtaagacgttgttgttgcgtgcggatatggacggcttgccgatggtcgaagaagcgaatttggaatttgccgccaaaaatcaatgtgcacatttgtgcggtcatgatattcatgcgacaagtttattggttgccctgatcatgctcaaagaagatgaagataagttgcaagggcaaatcaaatttttattccaacctgccgaagaaacgctgaatggtggcaagttgatgatcgaaaaaggggtgttggaaaacccaaaaccggatgctggtctagcactccatatgtggcctaatggtgaaaaaccagggattttgataaataaagaagctgcattggcatctgcattgaattttaaaatcgagattaagggcaaaggggcacacggtgcgatgccttataacggtgtcgatcctgtgtttgtggcttcgcaaattattaacggtgccaatggtattttggcacgtgagttgccttccagcaaaggggcttctttatccataggatcgatcagtgcaccgggcggggcaatcaatattgtgcctcctaatgcgtatttggaaggaacttcccgctcgttatacgatgattcggctaaacacatggcaaaacgattgcctgaaattgtcgagcatatcggtaaggcattcagagccgagacagtctatgaggaagtagcgaatgtgcctgcgttggtcaatacgcctaccatgtctgagttggtcaaagcttctgccgaagaagccttgggcccggaatatacggtgaaatatattgatcctcttttagcttccgaagactatgcccatatcgccagtcaattgcctgaatcctgctatttctttgtgtcttgcccgcaaccggatgcggacggcaatgtctatgcggtacaccaccctaaggtggtcttcaatgaagaggcattgattatcggccctgcaactatggcacaagctgcggtgaactggttagcaagtcatcgttaagggggtgactcaatgagccagtgtggtgtgtattgaaatatcaatcccattggcttttttgtttttgaattaaaaatatttcattcaaagttttccgtcaatatccgctttgggatcccttgccatttaaaaaattaacccaagcggttttttttgcataaacagaaaaaagttgtagcaattattacatcaatatagacttgttccgattttaactcattgatattttagttaatctaaaaatttatggaaataaaatagccatgaaaacactcagtcaagccgctaaagtagtcacttttttacggcaaaatccacaacaaaaattcacggctcgcaaaattgccgaagcaattaccgctcaatattcgcctgattatcagcataaaaaagccaaatttgccaatgaagggaaatttatgcagcaaattgtggcggaaattggttcgcagaaagatgctattttaaaaaattgccccgaaattcaaatacaggataagccacgtccgcgcctattttggtatgaaacaggaaattcaacaaaaggtgctttttctgaaaacacttttgttcaagtcaacgataaaaaaatctcagaacacgatttgtatcctcaactcatgcaatttttatcacaagaattgaacttgtactgtttacggattgatgaaaaacgctctaaaaacaatcgtggccacaaaggtaatcaatggctacaccctgatattgtcgctatgcaagccttggataaacaatggacacaagatattcaagattgtgctaaattgggttcagggaaaaatgtggtattgtggtcgtttgaagtaaaatgcgaattaaacggtggaaatgtgcgtgaaagttttttccaagcggtcagcaattccagttgggcaaatgaaggctatttggtgaccaccgccattgttggtgaacacaccgaggaagaattgcggattttgtcggcattacacggcattggtgtgataattttgaatttagacgatttaaacgaaagcgaaattttattgcctgccaaacgcaaaaccgaaatagattggcaatctgctaatcgcattgtggaacaaaatacggattttaacaaatttattgaatacgttgccatttattataaaacaggcaaaattgttaaagagagttggaataaataaaacatgattaccaaacacaaccttcccgaattattaaaccatctcggttttaccgaacagaatcaaatctaccgcaaagtttttcatgggcaatatgaattaagcgtggatttcaaagcagaaaaaatccattatcccaatggtttaaccgccgaacgcgacaccacgctcaatttcagccagcctgaaaatttcgtggtgttggaatgcgtgtgccacttattgcaaacgagttacacgcccaatcaaatcgttttagagccgaaaatgacaggcggacgcgaagacaccagtttttattgcgatattttattgcgcgataacgaccacacgccctatatgttgattgaatgcaaaaccaccgacaacagcaacagcgaatttgaaaaagcatggcgcaaaatgcaaaaagacggtggtcaattgttcaattatttcaacagctaccgcaaagcacaatatttatgcttgtatgcttctgactggaatggcgaaaacgtagaacacagctaccgccttgtttctatgaaagacaacaccgaatatttaaaaagcgatgaaaaattgattggttatgagcaaattcacgcagaaagtggcagcaaaagcgatttctttgaagtttggaaaaacacttaccaactggacgcaacagaacatcaattatttgaatctgcgccatttaatatcggcacacgccccttttcagccagcgatttgaaagtggtggataacaccagcattcagaaaaaataccaccaattcgccaccattatgcgccaacacaatgtttcggggcgcgaaaatgcgtttgataaattggtgaatttgtttctcgccaaaatcaaagacgaaagcgaaaacccaaatgaattaaaagtttattggaaaggcgcggcacaagataattattttgacctgcaagaccgcctgcaagcactttacaaaaaaggcatggacgaatttttgggcgaagaaattacccacgttaccaaagaagaaattgaagccgcctttatcttattcaaaaacaaaaaagacgaaaccaagaaaaccattttggacaaattcaccgaaatcaaatattacaccaacaacgatttcgcctttttggacgtacataataaaaaactgtttttccaaaacggtgcaattttgaaagaagtggtacagatgctacaggacattcgcctaaaaaccgacaatggcggcgaaaatcaatttttgggcgatttgtttgaaggtttcctagaccaaggcgtgaagcagtcggaagggcaatttttcacgcctttgccgattgtgcgttttttggtgtcgtctttgcctttggcagatttgatttcaggcagcgatgcaccgccgaaaatgattgactatgcttgcggtgcggggcatttcttgaatgaatacgccagccaaattcgcccattggttcaagcatttaaacaagcggacaccgcaccttattatcaagccatcgtcggcattgaaaaagaataccgcctctccaaagtggcgaaagtttccgcgtttatgtatgggcaagacggcattcagattgtctatggcgatggtttgactgcacacaacgataaagtgaaagtggaaaatggtgcgttttcggtgctggtcgccaatccgccgtacagcgtgaaaggttttttggacacgctttcagacgatgagtgcaaatctttttcgctttacaaacatgtggataaaaccgatacctttaattccattgaaacttttttcattgaacgcaccgcacaattgctccaacaaaatggcgtggcggcgattattttgccgtcttctgtgttgagcaatggcaacatttacatcaaagcacgcgaaattttattgcaacactttgatattgtggcgattgccgaatttggttcaggcacattcggcaaaacaggcaccaataccgtaaccctgtttttgcgtcgcaaatcagacgcacccagcttgtccgcacattaccaaaaccgcgtggatttttggtttagcaatgacaagtccgccgatgaattgttccaagacgcacatttattgcagcaatattgccaacattgcggtttaaattggcaagattatcaagactttttgactttcaggctgcctgaaagcggtattttcgccgattaccgcgaaacttatcgccaaagcactgattggaaacaacgtcaagccaaacgcgattacaaagcactttccgatacggaaaaagcagatttgtttgaacaaagtgcgtgggcgtttgcgcgtgaaatggaaaaagacaaattgcattattttttattggcttatgccaatccgcagcctgtactcatcatcaaaagccccgccgacaacaaagaagcgaaaaaattcttgggctatgaatggagcacacgcaaaggcagcgaaggcatcaaatacatcggcagtagcgaagcggaaaacgaagaaaaccccaaccgcaatcaaggcattttcaaaatgcacacgccacttttcaatccgaatgatttgcatgactctagcaaactcaatcacttaatccgccaaaattttcaggccgcctgcacgcaaacgcagcctgaaatcagcgaagatttgcgcccatttgccagcttgcgtcctttgcatgaaatgctggatttttcgcgcacggtgtttgataaagccattcagacggcattggtggagaaagtggaaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaccattggatattcagcaacaaatcattgccgaatgccaaaaaattgaccaagaatacgaaaccagccgcatggcgattgaaacctatcgtgccaaaattgcccaaatattcagcgatttagaagtgctggcacaaaattcatcgaggggggggtaaaactgtttaaaatcaaagatttatgcaaaacaaatccttcaaaaaatattttgagggatttgcctgatgacttgattgtttcttttgtggaaatggcatcggtcagcaatgatggttacattcaacaaaaaattaaccgtccattgggcgaattgcgtaaaagcagctacacctatttccaagaaaatgacatcattattgccaaaataacgccttgcatggaaaacggtaaatgtgcattagcaacagaattgagcaatcacattggcatgggtagctcagaatttcatgttatccgctcccaatcaccaacattgaataatgcttttttattccattttttaaatcggaatgaaattcgtcaatcagcagaacaacatatgactggggctagcggtcatcgccgtgtaccaatcgggttttatgaaagtttgccagttcccgtgccaagtattgagaaacaaactgaaatcctcgcccaaatcgcgcaatacgaagcccaaatcgccacttgcgagcaaaaaatccaatctttgcccgctcaaaaacaggcaattttggtgcagtatttgcagtgatgtaactttcagacaacctgaaaaataaaggcaggtaaatatccgaaaacgacttaattctttacacgaccacagacattcaagcccaatttttgttatacgaattgggcgggtaattgtggctaacgcaagcagaaattgccgaactggtcaaattaagaaaaaaacggcaaccctaccccatttcttcctgaaagtgcggtgttttttagcgataaaaatcatttcgttgattaaaaacttttcatgaagacaaaatatgtgattttttaaatgaaaaaatcgctatttgcaatgccgtttattgaatcaaatggttacatatcaatgctatcgttttttttgtttttgaatgtgaaataatgaagcgataatttgatttaatttatgtattgttatttaatatgcctatccgttggtaacggcgattattttattaagcatgacattacgcttgctgtctacactgtcaataaaacacgtttatgtgatggtctggggagtattttatgtcttgtttttgtgtgttgttgtaatctgtatatgagttttttttggagtatctataatggaaccatcctaccaggaacaaaacaattgtactgaaacgattaaaatcaatgaagtcaaaaaactttggttggacagtaaattttcccttaatttacctgtatggacattgttgttgcctttatttgcattattagtattggcatttcatttgctgacttacccaacaggctggttgattaatactgttactacggttttgcttatcggttcggtatttgctgcagtgcattatgctgaagtgattgctcataaggtgggggagccgtttggtacgttggtgcttgcaatagcggtaaccgttattgaagtggcattaattgtgatcctgatgagtaacagcacgcaggaaaattctttggtgttggcaagagatacagtttatgcggcattaatgttgatttgtaatgggatcgtgggtatcgggctgctgataggcggtatgaaaaattatgtccaattatttagcttgcacggtattaaggctgctgtcagtgttttactggcaatttcattaattgtttttgtgttgcctaattttacgctttctgccgagggtggtggaatggtcaattcacagctgttgttcgtggcaatgtgctgtttggtactttacggctctttcatttttacgcaaactattcgccatcgtaattattttgttgatgaggatgaaaatgaaagccatcacaacgacaattggttaacaattggtgtgagtattgtgtttttattgataagtttagtttctgtggtaggactggctaaaatgctatcgcctactattgagtctgcactagttagtttcgggttgcctaaaataatgttggggattatcgttgccggtttggtattgttgccggaatcaattgcttcaattaaggctgcctataataaccagttgcaaaacagtctgaatcttggtttgggttcggcattagcatctatcgctttaactgtgcctgtgattgcgattatttctgttatctccggccagcctattgtgtttggtttaacagccaaagaaagtttgatgctgattattacacttttattgacaatgaatactttaagcacaggacgtagcaactttttgttgggagttattcatttggtaatgttggcaacttttattttcttttccatcattccttgattttgaaatgaatgatttacatcagtaagtacgaagagaaaatcaatcacattattatcgggtagaaatatatgaaaaatagaaatttttattttggattggggtttattgctttgcttaccattatcgtgagttggttggcaaatactcaatttgcacatcaagcgaaaatcagtgctttgactatcgcaattttgttaggcattttaattggtaataccttttatcccgcactttcatcaaaactggacaaaggcgtgttatttgccaagggaacattgctacgtattggaattatattatatggcttccgtttgactttgcaggacattagccatgtgggaatcaatgccattgttacagacagtgttatgttgctttccacttttttccttgctattgggataggaatttattggcttaaaatggacaagcagacggtgtatttgacggctggaggctgtagcatttgtggggcggcggctgtgatggcaatggaacctgttaccaaagccgaatctcataaagtatccgttgctgttgcggtcgttgttatttttggcacgattgccatgtttctatatccgtttgcctattcttatttacaacattggctaacagatcatcaatttgggatttatatcggttcaacggtacatgaagtagcacaagtttatgctgccggcggtaatattggtcctacggttgctgatacagcagtaatcaccaaaatgattagagtaatgatgttagcgccatttttattagttttatcttgggcattatcaaaacagaaatcagataaaagtaaaattaatattccttggtttgctttcttatttattctcatggcaatctttaattcctttgatattttgccaaaaagtgcggttaaatttattgtaaaattagacgatttactgttaattgccgcaatgatagctttaggattaaccactcatattagcgctatcaagaaagcgggtgtaaaacctttattattagggatgttactctttatttggttggttttaggaggattagcagtgaatttgttaatgcaaggatttttataaagataaggatattattttgaacaatcttactgaaacgtttactctcgaacctcaagataatgcacgcttacaatccctttgtggcacatttgatgagcatttgcaattaattgaaagcagttttaatttggttgtttcacgccgtaattttacttttactgtacaatccgcagacgaagaagaaaaaaacacgtatcatccaactttgctaaaaagtgcggtgaaattaattaaaaatttatatgctgacactgcaaaaattcgtggcaaagtgaaagagctggatttggaagatatacatttggcaattcaagagagccgaatgttattacaaaataatactcaaacaaagcgggaagatagtaaagtttatagcacaacgattaaaactaaacgtggcttaatcaaacctcgtggtaaaaaccaaattgaatatttacataatattctcacacacgatattagttttggtattggaccggctggaacagggaaaacttttttagccgttgccgcagcggttgaagcattagagcgtcaagaagtgcgtcgtattttgcttacacgtcctgctgttgaagccggtgaaaaattgggttttttacccggtgatttaggacagaaaattgaaccttatttacgtccgctttatgatgctttatttgaaatgttagggtttgagcgtgtgcaaaaattaatagaacgtaatgtaattgaaattgcaccgttagcttatatgcggggacgaacgttaaacgacagttttattattttagatgaaagtcaaaacacaacggttgaacaaatgaaaatgtttttaacccgaattggatttaattctaaggctgttgtaaccggtgatgttacgcaaattgacttacctcgtagtcaaaaatccggtcttcgccatgcgattgaagtattagaaaatgtgccagaattaagttttaactattttgacagcaaagatattgtacgtcatcctgttgtggcaaaagttgttcaagcttatgaggtttgggaaattaaagatgaatttcgtcgccaacaattagccgagcaaaaacaacaagagcggttagaaaaagagcagtttaccgaagaacgggtaaaagcgttacaagaataattttatacaaaggttcaattcatgaaaaatgtcattattgacctacagatagcgagcgaagatgcgaccaatttaccaagtgtggaacaaattcaactatgggcaaatgcggcaattcgagcggaaaactcacaacctgaaatgacagtacgcattgttgatgaagaagaaagtcaccatttgaatttaacctatcgtggtaaagataagccgactaatgtgctttcttttccttttgaatgtcctgatgaaattgaattaccattaattggtgatctagtgatttgtcgtcaagtagtagaacgagaggcgacagagcaagaaaaaccactaatggcacattgggcacatatgatcgtacatggtagtttgcatttgttaggttatgatcatattgaagatgatgaggcggaagaaatggaaaggttagaaacggaaattatgctttcgttaggttttactgatccttatattattgagaaataaccaacctgaaatgatatctcctcgccatgtgcaaattagtattgcacccaatctgcaagattttggaccgcactttttatcacattttgatgttttgtggttagggtgggaaaaacccgattttaatgtgcatttttgccatgtgcaaaaagcaaaaaagttacttgggcaagagtttttaaatgtgatttttgatgctcgtcagggatttcatttagaaagtttagcgattgtggcaggaacagtaaaagcgggtggaacattaaatattctacttaatcattgggatcttttagaacaacaagctgatattgatagtttgcgttggagcggtgtagaaaaaatgattgcaacaccgcactttattcagcattttcaacgaattgttgatcaatttcagtttcctatcaatcatttcacgattccggctattaccccaaataatctacctgatttattttgttcagttcaattgagtgcaactaaagcacagcaaaaaattattgacagtattttacagcaacaggcggagatttattttttaaccgcaaaacgtgggcgaggcaaatcagcgttgttgggtttgttatctcaacaagtaaaacagaaagtttatttgacggcaccgaataaaagtgcggtgaatattttgcaaaagttcgccggtcaatcagttacttttattgcacctgatgagtttgttcagtgtttgacagaaaatccgcaagactatcgaaatgcttggctatttgtagatgaagcagccatgctacctgtcagtaccttaaatttttttagtgcttattttaaacatattgtttttagtacaaccattcatagttacgaaggtacggggcgtggttttggcttaaaatttaagcaacgaattttacaacaacggcgaaaatgtcttgaatttgaattaaaggagccattgcgttggcgtgaggacgacaagttagaaccttttattgatgtgcttttattgcttaatagtgaagatgattttcggcaatatcattacaaatccaatttggacgttcacataaaatcgctaaatcaacaggcgttattgacacaaatagcagatttttacggtctattgtctttagcacattaccgcacttctcctattgatttacgtcgtttattggatgctccaaaacaacgattttatttggcacagacagaaggacatttgcttggtggggtatgggcattagaggaagggggattgtcggatcgaggattgattgcgggaatttgtcgaggagaacgccgtccgaaaggtaatttagcagcacaattattggcttttcaatatcttaattcacaggcttgtgaattacgttctttacgaatttctcgcattgcacttcaacctaattggcagagaagaggagtagggcgagatttgatagctgctttgaaagtagaaagtaacattgattttttatcagtgagctttggttacagctcggagttggtttctttttggcataagtgcggttttaatttagtgtatttgagtgagtataaagaaagtagcagtggcacatataatgcaatggctatttgtcctttgactttgcgaggcaaagaattttcacaacaatgtatgagtcaattcagacgagattttgttttatcggatcatcctttattgaatgaggttataaataatcaaactattgaggtagagttaaatgcctttgatgtatactcattgcaaaaatttgcattttattaccgcactttatcggctgctcgtcctgccttatggagactattgaagatgatagctccctctgaatgtcctgtcttgaggaaatatttttgtggtgaaaaagatttcttgtcttatggcggttatcgacaaggagtgataatttgccgcaacgaagtaaaagaagtgttgcaaaaatataaaaactttctatgatggagtgatttttatacaggaaggagaatgtgatgccggatcaatcagaaaagaaaggttttttccgccgtatgctggatgcgtacaatcaattttgtaatgaaatggaggtggataaagggacttgtcgaggctgtgtacctatagtcaaatttgatgaagatgcaaaacaagaaacagataatgaggctggtaaagcatcataattgtgaagtacttcacataatggaaaagatttagccaaccaatgtacccatcttagtttacttaactataacaactctctaaaatacgcacgctttacttcagtgaagttggcgtatttttattattatttttaggtgattattatgttatggtttttcttttgtgttgccctattgattttaggctatttcacatacggtaaatttgttgagaaagtatttgttatcaatccgaacaagaaaacgcccgcttattctatgacagatggtgttgactatgttccgatgtctaaaaagaaaatttggctaattcaattattgaatatcgcaggcacaggtccaattttcggaccgattatgggggcattatatggaccggtggcgatgttatggattgtactgggttgtgtatttgccggtgcagtacatgattatttctgtggtatgttgagtgttcgtaatggtggtgcttcaatgcctactcttgccggacgctatttaggtactcccgttaaagtatttattaacgtacttgccgttgttttattattccttgtcgggattgtgtttgtaaccagtcctgctcagttattaagtactattactttggatatgtttggtagtgcaagtatggctacaaccaatgcacatgaggtggtaagtgcggtacaaaacgctggtgagatccgtgtttggggaatggataaaccgacagttgtggcgatttggactggaattattttcctttactatattgtggcgacattgttaccgattgataagattattggacgtatttatccattatttggtggactattattatttatgtctgccggtatggtatatggcttagtatccagccatttaaatggtgctgatccaattgaatttttccgttccgttgatggtatgagttttgaaaaattcttacaaaactttgaaactcgtaaagagctaccattatggccattattattcttaaccatttcttgtggtgcactttccggtttccatgcaactcaatctccattgatggcacgttgtgctgaaaatgagaaagaaggtcgttttattttctacggagccatgattgcagaaggtgttattgctttagtttggtgtactgttggtttaagtttctatgaaaatttgggtgaactattagctgcaacccaacaaggttcaccttccaaagtagtgtatgattcttctatttatttcttagggactattggtggtgtttttgctgtattaggggtagttgtgctacctattacttccggagatacagcattccgttccgctcgtttgattattgcggagttcttaaaaattgaacaacgcactttggtgaaacggttacttattgcagttccgttatttgcagtcggtttttggattattgcatcaaaaattgactttggtgtgttgtggcgttatttcacttgggcaaaccaagcaacagcaatggtgatgctatggacagctgcggcttatctatatcgttacaataaattccattgggtgtgtactattccggcagcgtttattagtgcggtatgttttacatacttagcctataacaaaattggttttggtttagattatcaactttccgtttatattggtattggattaactattttttgtttagtggctttctttactttattgaaaccgttaggttcgaaagatccggatgcctttataaatgatgtaacataattcataagtaatagataaaaaaccgttcgaggcaacttgaacggtttttttataaaaaatttactttatttatatgttttcaagataaaaaacttgcaacctaatctcactggtaatacacttatgaagtggtaaaaagtggaattttgtggagaaatttgtcataatcttcctcatttatctgcgaccaataattttttgtgattaaagtaaggaaacaatatgtttcgaggggcatcagcggttaatcttgattctaaggggaggattgcaattcctactcgctatcgtcaggaaatcctcgaaataaatcaggggcagatggtttgtaccgttgatattcgccagccttgcttattactttaccctttaaaccaatgggaaattattgagcagaaattatcgaaattgtcgaatttcaatccggaagagcgtagtttgcaacgtgtaatgctaggttatgcaactgaatgtgaacttgacagtgccggacgaattcttattagtgctcctttacgtcaacatgcaaaattagaaaaatccattatgttggtggggcaattaaataaatttgaaatttggagcgagtcagagtggcaagctcaaattgaaaaagatatgacattaggtgcgagtggacaatttgccatgtctgaagcattaagtatgttatccctataataaaaaagatacgttacagtcagtaacggtactagcaaaggtaaaaaggtacgttttttgttgtaccttttatcccttttgattttattgatttttcctaggttattgcaaatgagtatgcaagatacattttcttcacctgagcatttcactgttttattaagagaagcagttggcggtttagccttaaaagaaaatggtatctatattgatgggactttcggtcgaggcggtcattctcgttttatcctttctcaactgtcaaaaaagggtcaattaattgcgattgatcgtgatccccaagcaattcaggttgcacaaaatattcaagatccacgttttcgtattgtgcatgacagcttttcagctattccggatatttgtgaaaaattaggattgacgggcaaaattgacgggattttacttgatcttggcgtgtcatctccacaacttgataatgcggaaaggggattcagtttcatgaaagatggtcctttggatatgcgtatggatacgacacaaggattatcggcaacggaatggttgaggcaggtttctgaacaggatttagcatgggtattgaaaactttcggtgaagaacgctttgccaaacgtatagctcaggcgattataggatataacaaaagtgcggtgcaaagtggagcagaacctttaaacagaactttacaattagctgaactgattgctcagtctgtaccttttaaagataagtataagcatcctgcaacgagaagttttcaagctattcgtatttttattaattcagaattagatgaattagaaaaagtattgaatggagctttaaatgttctcgctcctcaaggacgtctgtcgattatcagctttcattctctagaagatcgtatggtaaagcattttatacgtaagcaaagtaaaggtgatgatttgcccaaaggattgccattgcgtgaagagcaaattcaacataatcaaaaattaaaacctgttggtaaagcgattatgccgacagaacaagaaatggctgctaatgttcgttcaagaagtgcggtcttacgcattgcggagagaatataatggtaagagatttcgaacgctacccattgtataaagttatttttgaggacttggtttctgcaaataaattattaattgttttaacgattttggttgtattgagtgcgttaagtacagtttggattactcatcaaactcgtattttagtcgctaaaaaaagtaatttagttgttgaaaatcaatcgcttgagcaagaatatttaaatttaagattagaggaaaaggcccatagtcttcattccgatatagagtcttttgccactcaaaagttgaagatgaaatccgttccggctgaacaagaggttgttatcattgaatagataatagatattaggcggttattaatgacacataataagataaatcgaaaaaacaaacgagcatttgaaaatggtgcaaagcgtaatcaacctaaaaagatctatgaaaatagtttcttgaaatggcgttttatggttgttgttggtcttattattttatcactcacagctttagtgggacgtgctacttatgtacagatgattaaatccgatgtgctatctaatgaggcggatgaacgatccttgcgtaaagaaaaaattttgtctatgcgaggtaccattgttgatcgcaatgggcaacttttatcagtgagtgttcctatgttttcaatttcagctgaaccaaaaaaaatttttagtaaaaatggtttacaagatgaggaacgctggcgtgcattagctaaagcattaggtatgtcttacaaggacttacgaaaaattctagaaaaaaatcctaaatctagttttgtctatttagctcgtcaggtgtcaccaaccattgcggagtatgttaaagaattaaatctatatggagttaacttaaaaactgaacctcgtcgtttttatcctaagacagaggaaactgcacatttactcggctataccaatatagacggggaaggtattgaggggatagagaaaagttttaattcatttttagttggtaaacctggatcaagaacagttcgcaaggataggcatggtaggattattgagaatatatcagatcttaagaaatacgatccgcaaaatgtcattttaagtattgatgaaaaattacagtccgtagcttatcgtgaaataaagaaagctgttgaaaaatacaaagcggaatcaggaacggcagtacttgttgatattcatacgggagaggtgttggctatggctaatgcaccttcttataatccaaatatacgcacaagttttaagactgaagtgatgcgtaatagagctattacagatactttcgagccaggttcgactattaaaccttttgttattttgaccgcacttgaaaaaaaagtagtgcgaagagatgagataatcgacactggtcgtttagttttagatgggtatgaagttaaagatgttgcagtcagagatcgccaaacgcttgatcaaattttagaaaattcgagtaatagaggggtgagccgtttggctttgcgtatgcctgcaaatgcactaatagatacatataaaaaagcaggtttagggcaacgaacagaattaggtttagttggggaacaggcaggtttcttgaatgccgatcgtaagaaatggtcagatattgatagagccagtgtttcctttggttatggcatcagcactacgccgttacaacttgctcgtgcctatgttaccttgggcagtttcggtatttatagacctctttcaattacaaaagtagatcctcctgttattgggcagcgagtgttttctgaaaaaatgactcgtgaagtggttaatatgatggagaaagttgcgataaaaaataaaagagcaatggtagagggttatcgagtgggaataaaaacaggaacagcaaagaaaattgaaaatgggaaatatgttaacaaatatattgcttatacagccggacttgctccaatcagcaaccctcgctatgccttagtggtattaattaatgatcctaaaggtagagaatattatggtggggttgtttctgcccctgtattttccaatattatgagttatgctttgaaagcaaataatattcctcctgatagtagtaactatacaaaaactgttagacgtacagtttatctcaatagtcaagagaataaagcgaacgccaattaatcattcaggtaatctatgaaaaaattaaccgcactttgggatattgatgaacaattagatagcgttcatagagatattgaacttcaagaaatgattttagacagccgtttagccaagaccggctgtctttttgttgcgattaaaggacatcgtgttgacggtcgagaatttattatgcaagccattcaaaatggagcaagtgcggtgctgtttgaaactgatctagtggagcagcatttgaaagtaagctttgagcaaaatattccgcttattgcgtattatgaactgtcaaaacatctttctcatattgcagatagattttattcatctccttcacaacgtttaacccttgttggcgtaacgggaaccaatggtaaaacaaccatagctcagttacttgcacagtggacacaaattttagggcatacaagtgcggtcatggggacgattggcaatggtttatttggacaaataaaagaagcttcaaatacaacgggatcggcaatagaaatacaatcctcgttagataaatttattcggcaaggtgctgattttgctgcgattgaagtgtcttctcacgggttagtgcagcatagagttgaggcactgacttttcgtgcaggcatttttaccaacctaagccgtgatcatcttgattatcatcataccatggaaaattacgcacaagcgaagaaacgtttgtttagtgaactgaattgtcaacataaaattttaaatgttgatgatgaaatcggggcaacatggttgattgaattaagtaaagatgatcctgatgtggttgcagtaagttgccgtgcggattatcagcctgatacaaaaaattggctaaaagcaaccgcacttagttttcacagcaaaggcacaacgattgaatttgcctcaagctggggaaatgggatcttaagtagcccattaattgggggcttcaatgtgagtaatttattacttgttttagccacactcttatcgcttgggtatgacatagataaattacttgctacagtacggcaattaaccggtgtttgcggtcgaatggaaatgttgagtgcaaaacataaggctaccgtgattgttgattatgcacatacaccggatgctttagagaacgctttgcaatctgctgcagttcattgtcagggaaaactttggtgtattttcggttgtggcggtgatcgtgatagaggtaaacgtccattaatggcagctattgccgaaaaatttgctgatagtgtgattgttactgatgataatcctcgaacagagaatcctgaacaaattatgcaagatattttgacaggttttcagcaatcaagtgcggtgcagattattcatcagcgtgagcaagcaattaaaacagcgttacaaagtgcggtagaaaatgatgttgttttgattgctggaaaaggtcatgagaattatcaaattattggaacaactaaataccatttttcggatcaggaaattgtaaaaaagtatttttaagtttagtaaaatttgaagtcattgatgagtaaaatacagaaataattcattgtattgaatgatgagaagtaagaaataacatgattaagttatcgacaaaagaactggctgacattttttccgcacgattaattggagcggaggatatttgtgtggaaaaggttagtaccgacacaagaaagccttgtttaagaagtttgttctttgctttgaaaggtgaaaattttgatgctcatgattatctgacacaggcagtagaacaaggttgttcagctgttgtagttgagcgtgagtgtgatgttgatgtaccacagttaattgtacctgatactcgtcttgctttagggcaattagctaaatggctaagagtaaaaattaatccaaaaacaatcgcaataacgggatcttcaggcaaaacaactgtcaaagaaatgacagcttctattttgcaaaaagtggcacaagatcctgatgcggtcttatttactcagggcaattttaataatgatatcggtgtgcctttgaccttgttacgtcttgagtcgaagcataagtttgctgttattgagttaggtgcaaatcatcaaggtgaaattgcttataccgtggatttagttcaaccggatgtggcattggttaataatgttgctgcggctcacttagagggatttggaagtgttgagggagtggcacaggcaaaaggcgaaatctatcaagggttaagtgaaaacggcattgccataatggaatatgagcattctgtgctctggaaaaaatattggtatgaacaaataggtaatgcagatactcgattgttttccgttatggggaaggtgtcggattactatgcacaagaaatcaaattaacggaaacaggcagtcagtttacattgtgttgtaccgagcatggagaaattaagattaatctgccttatttaggattacataatgtcagtaatgccgtagcggcagcctcattagcttcatgcttaggtgtgagtttagaacaaatcaaagcaggcttagaaaaaaaatcgtatgtaaaagggcgtttatttcccattgagccttgtccaaatctattgttattagatgatacttataatgctaatgtaagttcattgaaatccgctattgatgtattgcgacaatatgataaatttttccgtatttttgctgttggtgatatggcggaattgggggaaaattcagtgagttgtcacaaacaagtagcggattttgctcagatggcgaacttagatttagtggtcagttttggtacacaaagtgcggtcatttccgatgcttgtgatggcgttcattttagtgataaaaccgagttagtgaattatataatccccattattcagcaaaaattagccggtcaaaaagttgttttattagtcaaaggggcgagatgtatgcaaatggaagacgtgattaatttagtaaaggataaatttcaatgttagtgtggttagctgaatatttacaccaatatcaaagtgtatttaatgttttttcttacttgacagtgcgtgcaattcttgcacttttcaccgcacttttactctcgctatggattggtcctaaagtgattcgtcgtttacaaattttgaaatttgggcaagaaatacgtaatgatggtcctgatagtcacttaagcaaaaaaggcaccccaacgatgggcggtattatgattttatttgctataggggtcagtacgttattatgggcaaatttagccaatccttatgtttggttttgcttgtttgtattatttggctatggtgcggtcggttttgttgatgattatcgtaaaattacacgcaaaaatactgccggtttagttgctcgttggaaatatttttggctttctgttatcgctttagtctctgctttcggtatgtatgcgataggtaaagatacggatgcgacacggttggttgtgcctttttttaaagatgtcatgcctcagttaggtttgttttatattgtattggcatattttgttattgtgggcaccggcaatgcggttaatttgaccgatgggctggatggcttggctattatgccgacagtttttgttgctgctgcatttgcgttgattgcatgggcgaccggaaatattgaatggtcaaaatatttatatattccctatattaaacatacctctgaattggttatattttgtactgcaattgtgggtgccggtttgggttttttgtggttcaatacgtatcccgcacaactttttatgggggatgttggttcattagcattgggtggagtattaggtactattgccgttttagttcgacaagaatttttattggtgattatgggcggtgtatttgtcgttgaaactttatcggttattttgcaagtaggatcttataagttacgcaatggtaaacgtattttccgaatggcaccaatccatcaccattatgagctgaaaggttggccagagccacgagtaattatccgcttttggattatttcgctgatgttagtgttactcggattaattaccttgaaattacgttaaggcaagctatgactaatcaatatcaaaacaaaaatatctgcgtagtcggattaggtaaaacaggattgtcttgcgttgatttcttgttacggcagcaagcaaatgtacatgtcattgatactcgtcaacaaccgacgggagcagaaaaattacctgaaaatgtccccttacatacaggaagcttaaaccaacaatggctacttgaagctgatctcattgtgattagccctgggctttctgttaaaacacttgaaattcagaccgcacttcaggccggtgtagaggttgtcggtgatattgaattattttgtcgttacgccaataagccaattattgctattacaggctcaaatggtaagagtaccgtgactacattggtcagtgaaatggcgaaagaggatggcttaaaagttggaatggggggaaatattggtattcctgctcttgagttattgcaacaagattatgatctctatgttttagagctatcaagttttcaactggagacgacttatagtttgaaagcgacagccgcaacgattttaaatattagtgaagatcatatggatcgttatctcgatattgaagattatcgccaagccaaattgagaatttatgaaaattgtcaacgtgcggtaataaatgccgaagatgtattaacaacaacggaagatttaaagtctccaattacttttggagaaagtcaggctgattattggctaaaaacggaaaatggcaagcaatatttaatggcaaaagagcggttaattttaccttgtgatgaaatgaaattggtaggtcgtcataattatatgaatgcgttggcggccagtgcgttggttcaggctgtcgacataagttttactgcaattcggaccgcacttcgtaaatttaccggtttagctcatcgctttcagttagcatatcagaaagatgatgtacgttggattaatgattcgaaggcaaccaatgttggaagtacagttgctgcactgaccggtttgtatgtagctaataaattacatttattgttggggggggatggtaaatccgcagatttttcggaattggcaacattaattaatcaaccccatatttattgctattgttttgggcaagatggtaaagaacttgccgcactatcagtgcaaagtcagttatttgatacgatggaacaggcaatagaagctattcgtccgaatttacagcaaggtgatatggtgcttttatcaccggcttgtgcaagtttggatcaatttaaatcctttgaacatcgaggtgatgtttttagtgatttagcgaagttggcacagggttaaagatagagacaaaatgggacaaaataacgtaaaacaacatattgatcgttggttgcgtattacaccaacaacagcattatatgatcgagcattgctatggttgtttattattctattgtgcttgggattaattagtgtatcttccgcatctattccaatcagtacaagattatttaatgaacctttttactttataaaacgtgatataggatatatttttatctcgttaattgcttttgcgtttgttgttctcataccaatgagaatgtggcaaaaatataacgttatattattttggattgctgtgattttattattgctggtgcttactggaatcggaaaagatgcaaacggtgcaaagcgttggattccgttacaactatttaattttcaaccggctgaatttgccaaattagcactaacgtgttatttggcagattatttcacacgccgttataatgatgtacgtagcaaaaaattaagtgcatttaagccattttttgtcatggctatattgggtggattattattgttacagcctgatttagggagtgcggttgttttatttgttataacttttggcttgctttttattgtcggtgcaaatttttggcagtttgtagggttgggaggaatcgcttttttcttattcctatggttagtcgcatctgcctcttatcgtttaaaacgctttacaggttttcttgagccttttaaagatcctctaggagcaggttatcaattaacaaactctttaatggcttttgggcgaggtgagttatggggcgaaggattgggaaactctgtacaaaaattggaatatttgcctgaggcacataccgattttgtcatggcgattgtcggtgaggaatttgggcttgtaggcattattgtggtggtgttcttacttgcgttactcgtttttagagtaatgaaaatagggagagagtcattattattagaagaacgctttaaagggtttttggcttttggtataggtttttggatattttttcaaggatttgtaaatctcggtatggcattaggcatgttaccgaccaaaggattaacctttccattagtgagttatggcggttcaagcttgctgattatgtcagtcagtattgcaattttgttgcggatagattacgaaaatagagttgttcgagttggaagtgctcgactaagagatgattaaaataaggaaaataccgtgtcaaaaagaaaaaaattattggttatggctggcggaaccggaggtcatgttttccctgctattgctgttgcacaatatttacaaaagcaagattgggatatttgttggttaggcactcgggaccgtatggaagcaaagttggtgccaaagcacgggattccaattgagtttattcagatttccggtttaagaggcaagggattaataactttattgaaagcaccttttgtcattttaagagcggttctacaagcgagaaaaatcataaagaaatatcaaccggatgtggtactcggcatgggaggatatgtctctggacctggtggagttgccgcaaaactttgtaacatacctgtagttgtgcatgaacaaaatgctgtattaggtttaacgaattcattgctggctaaaattgcgacacgggtattacaagcatttccaaatacatttcctaacgcagaagtcgttggtaatccggtgcgtgaggcgtttttttctgtgcctatgccacaagaacgttttaacactgcttgtgagacactcaaagttttagtggttggaggaagtcaaggagctcatatattgaatacaatattaccggaagtattagctcaattgcctaatcgtctggaaattgttcaccaagtcggatcaggttcggtggaaaacgtcaccgcactttatcatgataaagttaatcttacgcaagaatcagtacaaattaccgaatttattgatgatatagctcaggcttatgcttgggcggatatcgtcatctgccgttccggagcattgactgtctgtgaacttgcagctgttggtacaccggctatttttgtaccctttcaacataaagataaacaacaatatttaaatgcaaaatatttagctgatgttggagccgcctatattgttgaacaacatgaattggatgcggaaaaaatagctcaattattaaaaaatgtagataaagaaaaattattggaaatggcggaaaaagcaaaaaatatgtcgacgccgttatccactcaacgtgttgctgaagttataatggatactgttaaaacttagccaattaaaatgaaaagaacattttgctatgtaaatgaataaaggaatgatgaatgcaagcatttagacaacgaattagacaaactgtacctgaaatgcgtcgagtaaaacaaattcattttgttgggattggcggagccggtatgggaggaatagcggaagtgttattaaatgaaggttatcaagtaaccggttcagatattgcggaaaatgcggtaaccagtcgcttaatttctttgggagctaaaatttctttctctcatcatgcagcaaatattgagggtgctagcgttgtcgttgtttccagtgcgattaagggagataacattgaagttattacagcacatgaaaaacgtataccggttattcaacgtgcacaaatgctggcagaaattatgcgttttcgtcacggaattgctattgcgggaacgcatggtaaaacgactactacagcaatggttgcaatgatttatgcacaagccggtttagatcctacttttgttaacggtggtttggttaagtctgccggaacaaatgcgtatttaggatgcagtcgttatttaattgcagaagcagatgaaagcgatgcgtcctttttacatttgcagccaatggtgtcggtagtgaccaatattgagcctgaacatatggaaacttatcatggcgattttgaagaaatgaaacaaacttatgtgaatttcttgcgtaatttgccgttttatgggttatctgtgatgtgtgctgatgatcccgttttaatggaattatcctctcaagtgggacgccaagtggttacttacgggttcagtgatgaggcggactatcgcatagaagattatcaacaaacaggttttcaggggcattatacggttgtaacgccgaatggagagcgtattgatgtgttgttaaatgtgccgggtaaacataatgctttaaatgcgactgccgcattagccgttgctaaagaagaagggatcgaaaatgatgctattttgaccgcacttgccgagtttcaaggtgctggtcgtcgttttgatcaattagggcaatttattcgtccaaatgggaaagtgatgttagttgatgattatggtcatcaccctactgaagttaacgtaaccattcaggcagctcgccaaggttgggagaataaacgtattgtgatgattttccaacctcatcgttattctcgtacccgagatttatttgatgattttgtacaggttttatcgcaagttgatgtgttaattatgctggatgtttatgcggcgggtgaacaggctatcgccggtgctgatagtcgctctttgtgtcgttcaatccgtaatttaggtaaagtagatccgattttagtctccgatcataagcaattagctgaaattgttgatcaggttattcaagatggtgacttaattttggcacaaggtgccggtaatgtgagtaaactttctcgtgaattagcgttagcttggagtaaagaatagttattagctcttcggagttacaaaataaaaaagtaggatataaaatgactaaaccattgaaacaacaaaaaatcgccgtcttattaggggggacttcagctgaacgtgaagtatcattaaactcaggaaatgcggtcttaacagcgttacgtaatcagggttttgatgctcacccaatcgatccaaaagaatatccggttgttatgttgaaagaacagggctttgatcgagttttcaatattttacatgggcgtggcggtgaagatggtacgatacaaggattattagagcaaataggcttaccctatacgggttgtggcgtgatggcatctgctttaacaatggataaaatgcgaactaaaatgttgtggaaagcattcgggttacctgttgcagatatggaagtcgttactcgcactagtttttcgcagttaaatccgcaagtagttgtagaaaaattgggcttgcctttaatggttaaaccttctttggaaggttcaagtgtcggattgacaaaagttaacgctattgatgatctaaaaagtgcggtggaatttgcacttcaatatgatgaaaccgtactgattgaagaatggctttccggtgatgaattaacggttccgatattaggtaacgaagttttaccttcgattaaaattgtaccccaaggggaattttatgattatgaagcaaaatatattgccgataatacgcagtatttttgcccctcaggattaacggaagagcgtgaacaagagcttcgtcaattagtcaaacaagcttatgatgtcgtgggttgcaggggatggagccgtattgatgtcatgctggacggcgagggtaaattccgcttagtggaagtcaatacaaatccgggaatgacaagtcatagcttatttccaaaatcagctgcaactgtcggttattctttcgagcaattggtcgtcaaaattttggagctaagtctttaaatgagaataacgcataaagtaactgaaaatttgaaagtgacaaaacggaagtcctaccgatttgtcaacattaaatttattgttatgttgttattggttgcaatactgatttttattgttagtaatcgtcagtcgattttagaaaagttagatgatagctcaattaattcatttgctattgcaggtataacaaattttactgatgacaatgatgttcgtgaagttttgtctcgaatatcggacagcggtgagttaaaaggtttttttggacaagatattgatttggttaaacagcaaattgaaatgataccttgggttaaatctgtggcagtacgtaaaatttggcccaatcgcttaagtatttgggtaacggagcatttacccattgcacgttggaatgaaacagaatttttgtcatcagagggaataatatttcaattaccaattagcaaattaaaaacacaaggattacctcatttgtcaggacctgatcataaaagtgctgaggtactggaagcttggaataaaatttatcttgatttaaagagaaaaaatttgttgttaaaaaaaattgctatcaatgagcgtggttcatggcaaattgtgttagagaacgatgttgtattaaaattaggacgtggagaatggaaagataaattggatcgttttttcacaatttatccacagattgaaatacctgaaaataaaaagttatcttatgttgatttaagatatggtgttggtgctgctatcggtgtagtagattctgactaaatttaattttaaatatgtgaagtgactaaaatggctagaattgtagaagataagatatttgtaggtttagaagtaggaacctcaaaagttgttgctgtagtaggggaattattacccgatggcgttgtcaatgtattaggtgccggaagctgtccttctaaaggtattgataaggggagcattacagatttaaatgcggtcgtaacttctattcaacgagcaattgattcaaccgaagcggttgcagatagtcagatatttagtgtgacattggctattaccggtgagcatattcaaagtttgaatgaaaatggatttgtgcctattgctgaggaagaggtgactcaagaggaagttgaagcggcgttgcatacggcgagttcagtccgtattggagatgggctggcattattacatataattccccaagaatttgcagtggataagcaagtaaatataaaagatccactaggattgcaaggtgtgcgtttaagtgctcaagcacatttaatcgcttgtcatcaagattggctaaataatctgaaaaaagcggttgaacgttgtaaattaaaagtgaacaaagttgtttattccggatatgcttcatctcaagcggtgttgactgaagatgaaaaagaattaggtgtttgcttaattgattttggtgccggtacgatggatattgtggtttataccaatggttttattcgctttagtaaagttattccttatgcgggtaatcgagtgactgacgatattgcttatgcttgtgcgacttctaggacagaggcggaaagtattaaagttgcttatggaagtgcggtcagtcctccattagatcctttagataaaaaaattgaagttgccagtatcggtgggagagcacctcgagtcatcagcaaagaacaactttcaattattacttctgctaggtatgcggaattacttggtgtagttaaatctgaattggatcaattgaaatatcaattagaaaataaacagataaaatttgaacttattgctggaattgttattactggtggcggagctcaaattgaaggattaagagaatgtgcaacgcaagtattcggttctcaagtgaggattggtgtcccgcttaatattaccggtttaactgattatgtaaataaaccacaatattcaaccgtagttggtttattacatcatcataataatgattttgaggatattttatctgaaagtgaaacagaaactgacggtgtcggcaaaaaattttggaatatttgtaagaaagttgtcaataaagtgcggtcagagttttgaaaatttgattttttaatctacaatagacagaatttaggttttaattttgtgctaaagtcgggaattagcatttacggagaagaaatatgattgaaccggttgattacgattacgatgatattagcggaggtgcactcatcaaggtggttggtgttggtggcggtggcggtaatgctgttaaccatatggtggctaatatgattcaaaacgatattggcgggacgctacttggcgttgatgaattggcttatccaatgtcagatgataatcatggcaaaattattttctatgctgtgaacactgatgctcaggctttgcgtaaaagtaatgtacaaaaaacagttcaaatcggtggtgaaacaacaaaaggcttaggtgcgggagctaatcctaatgtaggacgtaaggcagccgaggacgatcaggatgctattcgtgctatgttagaaggtgcagatatggtttttattgcagccggcatgggtggcggaacaggaacaggtgcagcacctattgttgcacaaattgcaaaagagctaggtattcttacggttgctgttgtcacaaaacctttctcttttgaaggtaaaaagcgtatgcattttgccgaattaggaatcaaagaattatctaaacatgtagattccctgattattattcctaatgaaaaattattaaaagtacttggcaaaaatatcagtttaattaatgcttttgctgccgcaaatgatatattgcgtaatgcggttactggaatatccgatatgattacttctccgggactaattaacgtggactttgctgatgtgcgtactgttatgtctgagatgggtcgtgcaatgatgggttccggtgttgttcaaggcacagcagctgatggtcgtgcagaaaaagcagcacaagaggctgttgccagtccgttgttagaagatgttgatttatccggtgcacgaggtgttttagttaatgttactgcgggattcgatttaactttagatgagttttcaacagtaggtgagactatccgttcatttgcatctgaagaggctaccgtggtggttggtacaacgttggttcctgaaatgtcagatgaaattagggtaactattgttgcaacaggaattggggacattgaaagacaagatgttcagattatgtcaacatctccactgaatgagcccgtaaaacctgttgaacagcagcatattcgtccagaacctagacatgatttagatacaccgattacagagagattaaaagcatttagacccgtagacccaacaagtttctctcgtgactaacagagttcatcttgttgtttagcaataaggttaaagaaagatgattaaacaaagaacattaaaacaaagtataaaagttaccggagttggcttacatagtgggaataaagtgacattaactttacgccctgcgatgccaaatacaggcgtaatatattgtcgaaccgatatgaacccgccggttacttttccggcaaatgcaaatgcggtacgtgatactatgctttgtacatgcttaatcaacgaggatggggttcggatctctacggttgagcatttgaacgctgctttagctggattaggtattgataatattattattgaggttgatgcgcctgaaattccgattatggatggaagtgcgagtccatttatttatttgttattagatgctggtattgaagaacaaaatgtagcgaagaaatttattcgtgttaagaagccaattcgtatagaagacggtgataaatgggctgaatttaaaccttatgatggcttccgtttagatttcacaattgattttgaacatcctgcaattggtaaagatgtacgtaattatgtgatggatttttctgcacaagcttttgtacaacaaattagtcgtgcaagaactttcggttttatgaaagatattgaatacttacaatcccaaggtcttgctttaggtggaagtttagataacgctatcgttttagatgattatcgaattttaaatgaagacggtttacgctttaaagatgagttggttcgccacaaaatgcttgatgcgattggagatctttacatgtgcggttataatattatcggtgattttaaagcctataagtctggtcatggattgaataataagcttttgagagcattacttgaaaatcaagaagcgtgggaattagtaagctttgaagataaagaagaaatcccgcaaggttatgtttctcctgcacaggtttttatctaaattagtgttgtaagataaaagctatatttccagcgaagtatagctttttttatagctatagtttttgcttttacctattacttgctggtatggaaaaatattcaattcatcgtaggattttatatgtcattagatttaaatgaaattcgtcaacaaattacacaaattgaccgcagtttattaaagctgctctcagagcgtcatcgtttagcatttgatgtcgtacgcagtaaagaaatctcgcagaaagcattacgtgatgttgaacgtgagcagcaattattgaaagagttggttcaatttgcggaaaatgaaaattatcaattggaaccacaatatattactcagattttccaaaaaattatcgaagattccgtgttgactcagcaagtatatttgcaaaagaaattgaatgagcaaagagagaagaatattcatattgcttttttaggtaaaagaggttcctactctcatttagccgctagaaattatgcaactcgttatcaggagcaactaattgagctaagttgtgcttcttttgatgaggtattttcctccgtgcaaaatgaagaggcagattacggtattgtaccgttggagaatacaacctcaggagcgattaatgaagtgtatgatttattacagcatacagatctttctttagtaggtgaattggcttatccaattaaacattgtgttctggtaaatgctcaagatgatttagataagattgatactttatatagtcatccgcaagttattcagcaatgtagccaatttattcgtactttagcgcgagttcatattgaatattgtgaaagcagctcacatgcaatgcaacttgttgccagcttaaataaacctaatattgcagctttaggcaatgaagacggtgggaatttatatggtttaaaagtattaaagtccggtatagcaaaccaagaaaacaatattacgagatttattgttcttgctaagaatccgattgcagtatcaccgcaaattcatacaaagacattattattaatgagtactgcacaaaaagcgggggcattagttgatgctttattggtcttcaaaaaatataacatcaatatgacgaagttagagtcacgtccaatttatggtaaaccatgggaagagatgttttatttagaaattgaggctaatattaataaccctatcgctcagcaagcttttactgaactaaaagcattcagtaactacttgaaaatcttaggttgttatccaagtgaaattgtgaaacctgccgaagtctaataaaaagtgcggtctaaatcaaaaaaatcccctttattgaaaaaggggattaggcgttgatttattttttcggtgcaagcaattcaggttcttgaggtttcgctacattttcaaaagatttattttgattcgcttgaataaggctgtctgcttgttgagccaattttgttagccccattttttcgtaagcatttttcatcaatggcaacgcatcaagagtagctttcgtgtcagggtattgttgtaacatacccactacacgatttgctacagcaacatgagcattgcgttttgcatagaatttagcaatttccaattcatgacgagcgaggcttgctctaatataagccatgcgtgctaaagcatccgccgcataagggctatttgggaaatgctgaactaacgtttggaagttagcaaatgcagttttgatagacgtactttcacgtgtcgcacgatctacaccaaaaaggtcttggaaccagttatcacctaatgctgaattgcttaaacctgctatataaatgacataatctaaatgcgagctttgcgggtattgttgaataaagcgatcaattgttactaaagcattagtgtagtcttgagatttatagtaagcataaattagatccaattgtacttgttcattatattggcttcccgggaagcgtttttttgccgtgtctaaataacgaattgcttggctataatctgcgtcttgtagataggtgtgtcctttttcataaagagtttgtgctgttccttcttcaatagctttacctgagcttgaacacgcaccaagagcaaggcttgcaaaagcgactaaagcgagagatttcaatttatgcatgagtgaatccttatttttacaatcaataataaatgttacaataattcgttattttatagcacattgctaaataagcaaattatctgatggattttttattatgacacaagtgatattgtcagccgatattcagccccaacatatgggacaacgcttagaccaaacgttagcagaattgttcccagattattcccgctctcgtttgaaaacatggattgagggtgatttagttaaagttaatggcgaaattattaatgttgctcgtacaaaagtttacggtggtgagttagtggaaatttgtgtggaaattgaagaagaaagcaagtttgaacctgaaaatttaccactcaatattgtttatgaggatgagcatattttagttattaataaaccaaaagattttgttgtccatcccggtgcagggaatcaaagaggaactgtattaaatgcactgttgtatcattatccaaaaatagtagaagtgccaagagcgggcatagttcatcgtttggataaagatacgacgggtttaatggttgttgcaaagacaattccggcacaaacaaaattggtacaggatttacaaaaacgtaaaattatacgtgaatacgaagcagttgcttttggtgtgatgacacaaggtggaaaagtagatcaacccatgtccagacatccgacaaaacgtacccaaatggcggttcatccgttgggaaaaccggcggtaactcattatcgtataatggaacgtttccgcaattatactcgcttacgccttcgtttggaaacaggacgcactcatcaaattcgagtgcatatggcacatatttcccatcctttactaggcgatcaaacttatggaggtcgtcctcgtccaccgaaaaatgcaagtgaagaatttatgcaagtgatgcgtgattttaaacgtcaagcgttgcatgcaattatgctccgcttaactcatcccattacaggcgaaataatggaatgggaggctcctttgcctgatgactttgtaacattaatcaatgccttaaaagcagattatcaattacataaagatgaattagattattagtatgcaaataataaaagcgaatctcggtcaagtagcgaatgttcaagggctaatgacaactcggcaaggcggtataagtgttgcaccttatgacagcttaaacttgggtgatcatgtcggtgatgatgaaagtgcggttaaaattaaccgcactttgttagtgaaagaattaggcttaccgcaagatcctatttttcttaaccaaacgcatagtacaaaagttctgcgacttccttatcaagaaggcatggatttaaatgcagatgcagtttatagtgatcaagctaaccaagtttgtttggtgatgacggcagattgtttgccggtactttttactaatagacaaggcaatgaagttgctgctgctcatgccggttggcgaggattatgcgacggtattttagaggaaaccgttaagcaatttcgtgttcccaaagaagatattatagtttggctaggtgttgctatcggccctaagttttttcaggtcggtaaagaggttgttgagcaatttatagcaaaagatcctcaagctaaaaatgcctttacgccggatcgggaacaggaaaataaatttctgggtaatctgtatcaaatcgccaaacagcgtctaaatgctttgggaattacagaaatttacggcggagaacattgtacatatagcgataaagagcggttcttttcttatcgtcgtgatggtaagacaggtcgattggcttcattgatctggttttccaagtaaaaaagagcggttagttgtattgagtatctaaccgcttaacagggaatagttattatccttcgaagccgtcaaacaaggcggtgcttaaatagcgttctgatgcagaaggtaagataacaacaatgagtttatcggaaaattccggacgttgtgcaattcgatcggctacagcgagtgctgcaccggatgagatccctccgagaataccttcttctgccattagacgacgagccgttataatcgctgtttcactactgactttttctacttgatctactaaagataaatctaagtttttcggaatgaaccccgcaccaataccttgaattttatgtggccccggtttggtttcttcacctgctagcgtttgagttatcactggtgattcttcaggttcaacggctacggtaataatttttttgccttgatcttgcttaatgtaacggctaattccactaattgttccgccagtaccaacaccagctaccaatacatcaattttaccttcagtgcctgaccaaatttcaggtcctgttgtttgttgatgaatggctggatttgcagggttttcaaactgttttagcattacatagtgatttggatttgaagcaacaatttcttccgctttagcaatagcccccttcataccattgacaccttcagtcaacactaaatttacccctaaacctcgcaataagcgtttacgttcggaactcatagtctccggcatagttaacgtgattttatagccacgtgctgcagcaacataagctaaagcaatacctgtattaccactagttgcatcaataatttctttatctttggttaaaataccatctttttctgcttgccataccatattggcaccaatgcggcatttcacgctaaagctggggtttctcccttcaattttcgctataatgttgccgttattaccaaagttttttaaacgaactaatggtgtgttaccaatagaataggaattatctgcataaattgtcattattttctcctaagagttgtgagtcgtattttttacagtatttttatcatagctttatgaatttcaaaatagcaaaacattctattttataactaaacgctatttcacaatcgtggttttaatccgtatgaggtttgttaatgtcgttcttaccggcataacgatattgttcaacccacatagctgttgcaccacagacagcaacaggaataatcagcaaattaatgagcggaataaatgtacataaagtcaccaaagtaccaaaagttaacgttaatgtatgtttctgtccaagttccgttttcatacgttgaaaaggcactttatggttatcaaaaggatagtcgcaatattgaatagtcatcatccatacagtaaacaaaaatgctaaaattggaataatgctttgtccaataaatggaatgaaactaagtagagatagagcaataattcgaggtaagctataagtcaatttttgcaattctcgttttagcattcttggaatatcttttagaaaatctaccgcacttccttcagtcggactttctcccgttaacattttttccactttttcagcgagcaaggcattaaaaggtgcggcaataaatccagagagtgttgtaaacataaaataaaaaatgcttaacaacataagtacagctaagatgagcagaatcatacttaaccagctaagccaatcgggaataaacgtgatcatgctctcgagccaagtactgaatcggtttataaataaccataacagccccgataaaagaagaatgttaagcaaaatcggcataacgacaaaacgacgcaaaccacgttgtctaatcaaatcccaacccataataaagtaatgaaaagctttttttatctctgttagttttaacataaattttccttaattgaaaaaacacacttatcaaacgacataataccgcagaattcaagtagggtaaaaaatctgtattttccatattaatcaacaagtaaaatatgataagctagcaaaaatttgctgttcgatgaagctaagtaggagaacaagataatggatttaaatgctattttaattattttaggtgtaatcgcattaataattttagttgcacatggcatatggtctaatcgccgcgaaaaatcgcagtattttgaaaattcaaaaaactttactcgagaggcacgtatccgtgaaccacaagaaaatcagcaatatcaaaccgctgatcaatctcagtcggattttcaacgtaatttgcttgaaactgataatgactgtttttctagtgaatcagcacataattctcaccaacctctttatcattatagtgagcaaagtgcggtacaatctgttgatcaaattaaaattaggttgcctgacagtgagtctaactatgtaatgcaagaacagttctcaccgaagcataccgactacgcctccatgagcattgaagaactggaaaaatcaattgatcttgatgagggaattaattcatcttctcaacatttacgccaagagctagctcaaatttcagggcaatcaatagctgatgataaggtcaatatagaagagcatatgtttactgaaagcagcatatcttttgtagaaccacagacaaacacggaatcccaaaaggttgttgaaaaaacaaaatcaggtaattcttcttttatcatgctttatgtggttgcctctgaaaatcaaggttttagcggtttgcaattgactaaaacacttgatgagctaggatttatttttggtaaaaaacagatttatcatcgtcatgtggacttaagtattacaagccctgttttgtttagtgtggcaaatattgaacagcccggtacgtttgatttaacaaacattgcagatttttacacggttggaattgcattatttatgcaactgccttcttatggtaatgctacagccaatttacgaatgatgattagagcggcaaaaaccatcgctcaagatttagacggtgttgttgtaacagagcaacaagaaatttttgatgaacaagctgaaagggattatttggatcgtgtttcttgagtggcaaaattcgggaaatattgaccgcactttatgctttaaactttcaataggcttttgtttaaaaatactgaaaactatttggatgtgggaagactacgtcaaaaatgctgtatgaatttgctataatcaacgaaagacgcaaaacaagtgtgaatttcagttaaattattgccataaaatatgatttatatcaataaagtattcaatgttggttgagtttgtaggctaaaattttgtagtatatgcaccatcaagtgattgcttgatgttcataaagttcctaaataaaataatcataatatagcaaaactgctttgtgacctccctcttgggaggtttttttaattaattacaaagttggaagtttaacgtttctttgactgatacactgttctcttcctatatgtctatggcactaggtccttactcgctaaatttctatgttcaattcgctaaatcctataatttcaagtaaaataaccgcactttttacattatagagagaatatatgtcatcacaatttgtttataccatgcacagagtaggtaaagtagttccgccgaaacgtcatattttaaaagatatttctttaagtttctttcccggtgcaaaaatcggagtgcttggcttaaatggtgccggtaaatctaccttattacgtattatggctggaattgataaggatattgagggagaagctcgcccacaacccggtattaaaattggttatttgccacaagaacctaagcttgaacctcaacaaaccgttcgagagaccattgaggaagctgtcgctgaggtaaaaaatgcgttagttcgcttagatgaggtttacgcattatatgcagatcctgaagcagactttgataaattagcaaccgaacaggcaaatcttgaggcgattattcaagctcatgatggacataatttagaaaatcaattagaacgtgcggcagacgccttacgtttaccggattggaatgccaagatagaacatctatcaggcggtgagcgtcgtcgtgtagcactttgccgtctattacttgaaaaaccggatatgttgttatttgatgaacccactaaccacttagatgcggaatccgtggcttggctagaacgtttcttacatgattatgaggggaccgttgtggcaatcacccatgatagatacttcttagataatgtggcaggctggattttagagcttgaccgaggagagggtattccttgggaaggcaattactcctcttggttagaacagaaagagaaacgtttagctcaagagcaagctacagagtccgctcgtcaaaaatctattgaaaaggaattggaatgggttcggcaaaatcctaaaggtcgtcaagctaaaagcaaagctcgcatggcacgctttgaagagcttaactcaagcgaatatcaaaaacgcaacgaaactaacgaactcttcattccacccggtccacgtttgggtgataaagttattgaagtgcagaatctgaccaaatcttatggcgaccgcactttaattgataatctttctttcagtattccaaaaggggcgattgtggggattatcggagcaaatggtgctgggaaatccactttattccgtatgctttcaggacaggaacaggcagattctggctctattactttaggtgaaaccgtggtaatggcatcggttgatcaatttcgtgatgcgatggatgacaaaaaaacggtttgggaagaagtttccggcggcttggatattatgaaaatcggtaattttgaaatcccaagccgtgcttacgttggacgtttcaacttcaaaggcgttgatcaacaaaaacgtgtcggtgaattatccggtggtgagcgtgggcgtttacatttagccaaacttctacaagtgggcggaaacgtattactattggatgaaccaaccaatgacctagatgtagaaacgttacgtgcattagaaaatgcgatattggaatttccgggttgtgccatggttatatcccatgaccgttggttcttagatcgtattgctacccacattctcgattatggtgatgaaggtaaagttactttctacgaaggtaactttaccgactatgaagaatggaagaagaaaactttcggtgcagaagcaactcagccacatcgtattaagtataaacgtattgcaaaataattctttgtataaagggaaatattatgaaaaaaatcattaccgtattatcagttttagctgtatctgcttgtgtttcaacagagctatcgacacaaaataagacatataacaatttacaagatgcacgtatccgtttatatgggcaaaatcgtcgtccctcatcaatggaaattgaaattaatggcaagactgaaaaaatcaccgttggaggtggtttgggacaggcttttggttcaatgcttggagttaaagggaatgaaagcattggtatgcctgaaactgaacttagcaaagatccttctgctcattcaaaactactttcggctatcttctttaaagaattcgttataccggcaggtaaagaagtaaaagttactaacagtattcatgacgtaacgaatatgggagaatattatacctcaacacatagaataaccaccactacaacatttaaagggtgtaacggtgatgtcattacttttattgcagaagcaggaaaagattatgaagtggctcctattagctctaatagagaatgtggtgtaactgtttacgagatcaaataattttatcagaagcccattataaactgtctataaagtaaccgcactttaagtgcggttcttttatgttgcgtgattatggcaggctcaatatcagcaataggatattcacttttaccggaaaaatcattgaaaattaacaatgacaacataaagctttctagatgaaatcagcacagaagagttgccccgaaggcactaaaaagattagcgaccgtatgtgttgaacaagaactttgccgagcttttatctgagaaagtcaaacagctcgtcgtactgtgctgtttgttgctaaaagtgttggttttattggaaacctaacctagtcataaaactctgtaaaactgtttgcggatctaaaaatattgaagaaaacaaccgcacttattggattaaagtgcggtaagtatttagctcaaattagaagcagtgataagacgttgtgtataagcatttttaggttgagtaaatacctgctcggttgtacctgtttcgacaacctcacctttactcatcacaataacattatcgcttagtgcttttactacagataagtcatgactaataaaaatatagctcaagccatattttcgttgtagtttattgagtaattcgatgacggtaatttgtgttgaacgatcgagtgcagaagtcggctcgtccagcagaacaaatttcggttcaagaataatcgcacgggcaatagcaatgcgttgtcgctgtccgcctgaaaactcatgagggtaacgattaatcatagagggagaaagattaacttcctccaacatattcatgactttttgtcgcctctcttgtttactcatgtgcgggcaatgcacagtaagaccttctgcaataatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatggtaaataatgggtggtttttgcattattttttgcataaaagtgatcggggtttagatggtttttaaaagatttttaaaacaggtttaaatctttaaaaatggcaataaagattaggcaaggcggtttcaggtgaaatcgcctttatttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatatggagagagccgcatgcgttatttgcagaagacgatgagcaggaggtatagcaatgttagagaaagttgcaaaatacagtcgaattttttcgggagcagtggcgattaccatattgctgattgcagtgcctgtgttttttatccacgaagccgtagcgataaagttgatggcgtcagcgtgtaatttttttgccatttttgtcttttttgaggttttaaaccttaaaagttgggtacaacaaaatatcgcaacattgataaaaagtgcagaaattgcatcaaaagccgcttatagcttaaagcagcataaagggctaaatcttgtggtcaatggcaacacagttacacctgatagtagtgaacgggaggtataaatggaaatgttactttatatcgctgttggcgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtcatggacagtatcgaccaagcctaccccatgttagaagcgattaaggcagagttggaatttaatcaacggctacgcaccgattttcccgacatttttggagaagggcgtgtttggcaagcggggacaattattacccgtatgaatcaaaaagtacaggtagcaggttcaggtaaaaaactgcggggattgcgtcatggtgcttaccgccctgatttagtgattttagatgatattgaaaatgacgaacaagtccgcaaccctgagcaacgggataaattacataactggctaaaaaaaaccgtccttcctctcggctcggcaggcgataaattagatgttatttacattgggacaattttgcactatgacagtgtacttaaccgcactttgcacaataaagcatggaatacggcacactttaaagcaattattcaacttcccgataatatggcattgtgggacagatgggaagacctctatttgcgtgacggcgaagcggtggcagaggccttttatcagcaaaataaagctgaaatgaacaaaggtgcgattgtctcttgggcagctcgcccactcttggcgttaatgaaaatccgagcacgagatggacacgccacctttgatagcgaataccaaaacgacccggttagcggtgatgatgccatttttgccaacagtatccaatattggacatcacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacgtcatttcccaaaagccgaccacgatgatggtcccgatgccttagaaatgctatggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttccgaccacccaagcaataaaatcacgcctgccaagttaaaaagtatttttgaggatgctgaggcgggcaatatccaaacccagcacgaactctttatggatattgaagagcgggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatatgaatttatcgcaaaaacaggggataaaatcattaacaatgtcattgtcaactgaaagtattgaaccagtgcatttgttgatgcaattaacttgtacagcgacgttaattcatttggcaacggggtttattgaagacgaaacatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcattatggacagagagatcagcccgcttactagggactatacaagtaagacaatcagtacactcgctaatgccgtgtatatcagattgaccacaccattaggctcttggtgggcagatgggcgtgtaggctctctgcttcacttaattcaacgtgaaaaagatttagcccgtgtcggtttgttagcacaacaatatgccgaggaagcattacagccgttaattgatgacgggcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacctaccccgatttataccgcactttaggcaataaaaacactttacccaatttaactcgctcagatgtcggtatgacggcgtattttgcgacagatgagattcctgagggctggattgcgtttgatgaaatcaaggaaaaggtaaaagaagatacctaccctgaattacataaatacctaactaaaaaatacggcgatattcaaaatgttcccaaagcggaagaccgttttttgcgtaatgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactcgtcctaagtctcttgttctcaaattgtgcattaaagccaaaaatacctttgacgatgtgcaattttggattaaagcattcggtgcggtggaaaatcaaggtgttttggacgcctctgctatcgttcaagaaatgcaggattttaaacagcaagccgaggaaaaaatacaatccattacagtgcagaaagaagagattatgcacgctatacaagaggagatgggaaaatcagattattcccttgttaaggtttgggagggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaatctatatcaaaaaaccaaacaacaggaaagcaacatgaacatttactttcaaaaaaagcaattaagcaattatcaaatttttccaatccctcaggatgtagagaattggattgaaaaagacgttgatgaaaaggaactggacacgcatgtattggtggaatttaacggcgagtatcaatgggtcgagaaatccgctgacccgatgacgaaatggaacgggaaaacatgggtcgttgatgaagagaaaatgaccgcacatttaacccaagtgcgggcggaaatgcgagagaaaatcaatgcgttgcgagatgaaaaaattaatggcggggtatttgtggaagcggtgggcaagtggattgatacggacgctacggcggagcggaatatcttatccgtcaaagccagttatgatttattcggtgatatggaaattgcgtggacttgtgcggataactctgttttgatgataaataaggaaaaattaatgcaaatttggcaggcgttaatgcaggctaaaacaagtaatcatgctaacgccttgaagcataaaaccgctatggagcaatcggacaatccggcggaatatgattattccagcgggtggacaaaatgctatcaggattatttannnnnnnnnnnnnnnnnnnnnnnnnnnnnnnnnnnnnnnnnnnnnnnnnnnnnnnnnnnnntatgaccgagttacagatgggcttattcgtaaaatcacgaaaggtcaatacagtcattgtgaaattgccattgagcaaacggcgtttttaagtggcgattattatccgtatatcacctacgattgctacagttcaagtcctcgtgatggcggtgtgcgaaaaaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnataatttctccaattgttaaacgtggagacagtgaattgaaaggatcttgaaaaacaatctgcatgtcttttttcaatgcttgagctttttctttcgataaagtggcgatattttttccgttaaattgtaatatcccctgataatcaagaatttgcataatagcacgtcccaacgttgatttacctgaaccggactcaccaacaataccgagggtttcaccgacttttaactcaaaagaaatatctttaacagcatggaaaacatttttcggtttaccgaacaatgtgcgttttagcacataatcaatatgaatattttgtccattgatgaggacaggtgcattttcagccaacggatgttttaaatccgtagggataggcgtcagtaattcttgtgtatagggatgatgaggttggttaaatacttgttctgtattacctcgctccacaatttcaccgttttgcatcacacaaacgtaatcactgtaacgacgaactaaacgcagatcgtgtgagatcaaaatgatcgccattcctatatctcgttgtaattcaagcattaaatcaagaatttccgcttgcgttgtgacatcaagtgcggtcgtcggctcgtccgctattaataaatccggtttattaataattgccatcgcaatcatgatacgttgtaattgaccgcctgaaaattcgtgtggataacatgccattttcttttccgcttcgggaattttcacttttttcagcatatccaatgcgtgcttataagcctccgctttactcattttcggatggtgaatagcagtcgcttccgcaacttgttcaccaatcggcaaataagggttgagtgaagtcatgggttcttgaaaaatcatcgccatacgatcaccacgaattaatcgcaactctttttctgataaagataatacttctttgttttcaaataagatttttgagtcttcactgtaactgatgattttttgcggcaacaattgcataattgccatagaagttacagatttaccggatcctgattcgcctacaatagcgagagtttgtcctttttctacctcaaaagaaatattacgaacggcgtgtacgacttcttcatctgtttttagataaacatttaaattttttacatcaagtaatttcattctattcattcctatttatcttttggatcgagggcgtcacgcaagccgtcaccaataaagttaaagcaaaataatgtcagacaaaggaaaaaagcaggaaatgcaatcaaccaaggcgatgtttccatttgtgcagctccatcgctcagtaaggctccccaactgctcatcggttcttgtgtgcctaaacctaagaaactgagaaaagattcaaataaaatgagcgaaggtacttccaacgaggcataaacaacgacaattcccaaaacattcggaataatatgtttccaaataatttgacgacgggaaacaccacaaacaatagcagcctcaacaaattctttgttttttaaactgagtgtttgcccacgtacaattcgagcaaggtttaaccaagcaatcataccgatagcaacaaaaattaagaaaatattctggccgaaaaatgttaccaacaatataacgaaaaacataaaaggaaaagaactgagaatttctaatgtccgcatcatgacaacatctacttttcctcccacataacctgagatagcaccgtaaatagttccgatcatcacagcgataaaagcaccagcaatgccaaccatcagcgaaattcgcccacctatagcaatacgcaccaataaatcacgtccggaagcatctgtcccgagataatgcccggaaacaaaatcaggagcgatactcatcatattccaatcagtgtcatcatagctaaaaggaattaacattggtatgaaagtaataaatagcaacatgcaacaaatgacaatcaagctggcaactgctgctttattacgaaagaaacgacggcgtgcattttgccataaactgcgtccttcaatgacgctctcacaagcgttttgcatgatattttcttccgattttgagcggttttgacgattagacaacatgagatctccttatgaatagcgaattttcggatcgataaccgcatatagaatatcaactaatgcattaaaaaagatggtaagcgtccccactaatatggtgaggctaagtactagagaataatctcggtttaaagctccattgacaaacagctgccccaatcccggcaacccgaatacactttcaatgaccattgaaccggtaataattcccacaaatgccggtgctaggtaactgataacaggaagaagagccggacgcaaagcatgtttgaaaataatttttttcaatggcaatccttttgctttcgctgtacgaataaaattggaatgcaatacttcaatcatggaacctcgtgtaatccgcgcgataccggcaacgtaaccgatagtaagagaaagaacgggtaaaaccatataataaagttgaccgtcgttccaaccgccggcaggtaaccactttaaccaaatggcaaaaaataacactaaaagcggtgcaaaaacaaagctgggcatgatcacccccgtcatcgcaaaccccatcacaatataatcccagcgactgttttgtttgagagcggcaaatgtgcctgcaactaagccgataatgactgagaaaataaatgcgacaatacccaatttcagtgacacgggaaacgcagaagcgattaaattatttacgctttgatctttgtatttgaaagaaggtccgaaatcaccttgcgagagatttttcaagtaaagcaaatattgtttaaagagcggttcatttaagtgatatttcgcttcgatattcgccatgacttctggaggataagtccgttcggaagtaaaaggactacccggagccaatcgcatcagaaagaatgaaaatgtaattaaaataaacaatgttggaagtgcttccattattcgttttacaataaatttcaacatcaagaactccaaacagattaaatgagaaaaagtaaatgttatttaaaaataaatcgtcaaattcccctaacctaatgttatcaattagggaaatttgacgggataaataagtttaatgtttaataatataaagatttctcaataaaataatatcttgaggatctttaccttcatagcccttaacataaggtttcaccaaacgcgggttaacatagttatatatcggtatgataggagcatccgctgccaaaatcgcttcggctttagcataagctttcatacgatctgtcgcctcggagaattgataagactcattcaccgcttggtcgtaggccgagcttttgtaaaacgctaaattgttacttgagttggagagaaaataattgataaacgttgtagcctgattgtagtcagccgaccaaccggcacgtgcaatatcaaattgtttgttgtgacgactttcaatatacgttttccattcttgattttccagtttaacatcaactaaaccacccgtattatttttccaaattgatgccgcggcaatagcaacttttttatggttttcattggtgttatataaaatggtaaatttcaatggattcgatttactgaaaccggcttctttcaataattgaacggcttgctgattacgctctttcattgataatttagtatattcaggttgctgaattgcaccaccttccgcaatataggtcggtgtaaacacgtatgtaggtatttgcccctgtcctaataccttatctgtaatgatattacgatccaacgctaaattcagtgctttacgtacccgtaaatcattaaatggtgctttcgtattattgatctcatagaaataagtacccaatgtacgtgaagtaaacacttgatccggcatttcagcttttaattttgggaactgctccggtggcaaggcatgatctgttatctccacttctcccgcacgataacgttgcacatccgtacttggattttgaatcgctaagaatgtcgctttatcaatcacggtttctttatcattccaataaagcggattgcggacaaattcaattttttcgttgataacgtgtttcgtcaatttataagcaccgttacctacgtaattttctactttgacccaagcatcaccgaatttctctacaacatgtttaggcaaaggtaagacagagtgatgtgtggtcataccaggtaaataaggcactgaattgcttaacgttaccacaaaagtataatcgtcaacggcttttacaccgagagaatctacttttttcttcccttcaataacatcttgtgcattttcaatttgcatgtacgtcaaataagaagaataaggagaagccgttttcggatcaacaagacgttgccatgcaaagacaaaatcatgggctgtaacaggcgtgccgtcagaccattttgaatcatgacgtaatttaaatgtccattgcttaaagtccggcgtactttcccacgaagtggcaacaccaggctgaggattaccgtcagaatccaccgtaataagtccttctaaaacctgtaaaacaacctctgcttcaggtattccttctgatttatgagggtcgaaactttgaggttcagctccattattgatgacaatttcttgctttttagccaacacggtaccagccggaacattggctgcaaaagcagatattgaaaaacctaatgccacggttgtggcaacaagagtgcgggttaatattgtgtgcattgttattctccattgtgattgttgtttgctctgctattaatacatgaaaagattgcttttgtaaataattcatactagttagatagtaagctaattagagtgaattattctagagggcaatgttacatgaattaaattcttaccataataaagtgcggtcatttctctaagtaaagatcgctgagtaaatagccaccttgcggtcttttcccttcataaccttttaatttcggatttttaataaataatccggcgtaatgataaatcgcgataaagggatgatgtttgcctaattcttcttcagcttgtgcataaatttccgctcgtttgttttcatcactttcgttgtaagatgcttcaattaattgatcaaacttttcgcttttaaagccgattttattttgcgaactattggaaagaaaatatgtcaaaaacgtgcttgcttcgttgtaatccgcagaccatgctgcaaatgccaagtggtaatttttctgattttttgtatctaaaaatgttttccactccatatttttcagcgaaatatcaaccagaccgtctaaatttttcttccacatagaagtaaccgcaatagcaatattttttagtccttcgttagtgttatacagtaattcgcttttcaacggatttgctttactgtaaccggcttcacgtaacagctttttagcttcttcgtttcgttgtgcttgcgtccaattagcatattctggttgggtgattttttctcctgcatgaatatagaacggtgtgaaacggaaagtaggtgtttgtccaaagcctaatactttttctgtaataatgttgcgatcgacggctaaatctaatgctttacgtactttaatattatcaaaaggcggttttgtcatattcatttcatacataaacgtacctaatttacgagagctatagatttgcgaatcgtattgagcacgaaatttaggatcatgataaagtgattgaggaatataagctatatccaattcgccggaacgataacgagctccccctgcactttccgttaaaatataaaaagtagctttattaataacagaatgggcgttatcccaataggctggattacgttccaaagtgattttttcatttaacacccgttgtgaaattttataagcaccgtttactacaaaattttccggttttgtccaatcatcaccgtatttttcaacaacagcacgatttactggataaagagaagtatgctgcgtaagaaggacagcataaggtacgggtgcatcaagggtgagttgtagtgtattatcatctaatgcggtaactcccaaaaattccggtgatttctttccagcaataatatcatctacatttttcattttcatgaagccaaggtaacttgcataaggtgatgcggttttcggatcaacaagacgacgccaagcatagacaaaatcatgtgcggtaagagaatcaccattagaccacttaatatttgggcgtagataaaaagtaacggttttaccgtcagacgaggtatcccagcgataagcggcaccgggaataatattaccgagttcatcggttttcaccaatccttcaaataattgttcagctattaaaccttcccccgatccttctattttttgtggatcaagggtagcaacttcagcagtaatttgaatactgatttcctgtttatccgccaattttgtaccttgaggaacttgtgccgaaaatgcgactgaagaaccgacaagtagaaataagcctaaaagtgcggttctatagtttttatattttaactttgtccatatattgtgttgcataaattttatccttttaagtaagattaaaataataagattttcattagtaaaatatttatgcgatgaagtaaagtatttttacaaattttttgtaatttttaattagcaacctaattactatttttgcattttcaaaaatgtaggagtagaattccgacatcttcaataattcatcataggcggtatttatgcaattgagacgtaaatacatcgcctcgtattgataggagcagcatatgcaatttgcgattatcggattaggtaaattcggaaaatcagttgcacgagagctgtataagctgggtaatcaagttgtgggcatggatattaatgaaaaaaaagtggagcaatgtagccattttcttagtgcaagtttaatccttgatgccacggataaaacagccttgcgagaacttaacattcaagagtttgatgcagtgttggtcagtatcggtgaaagtctggaaagcaatttactctgcacacttaatttaattgatctcaaagcaaatcaaatttgggcaaaagctaaaaatgcggcacatcacgctatactttccagtttagggattcaacatatagtaagacccgaaaatgatatgggtattttagtcggtcaatctatgaattgccctagtgtaacccactgtattccgctaggctcggatctctttttaattcatttccgtgttcaatttcaaactactattaccctcggtatgctgaaaaaacgctataaagatattgttattaccgctattcaacgaggagaacaacttattagcaatccggatgatgaaactgaaatacatcgtcaagaccatttgctgatcattggctatttaaataatctccgcactttaaccggcgaattaaataaaatccaaaatgaaatttgaacatatcaaaacaaagccaccctatgtattagcgggcggttttctctttatcattttaatcggcacattattattggaattaccctttgctcaccataaaagtatttcatggctacatgccttatttacttcaacatcagcggtaacggtaacggggctaagtgtcgaagatacagcaaatttcaccctattcggacaagttgttttaatgtgcttaattcaaatcggcggattgggatttatgacgtttgctatttacatagcaagacgaatgggtgccagaattggcttattcggcaatgcaattgctcaagaagcactgggtgatgtgccttttaatttacttctacatactgccaaaaacgttctaaaatttgcactgacttttgaacttatcgcaatgattattcttactgttcatttttatggtgatgtttctttttttcaagcactgtatcaaagcctgttttacagtatttccgcttttaacaatgccggttttgcactgagttcagaaagtttaatgccttatgtggatgacattgttgtcaatatagtcatcaccgtattgattattattggcgggttgggatttgtggtactcatggatatcaaaaatcaacgccaatataaaaaattctcactaaatacgaaggtagtactttgggcaacccttattttaaatatcgtttcctttctaatattttatattttagaacgacaaaacccgttaacatttggaccgctaagcgaaacaggtaagttgtttgccgcttggtttcaagcgataacaccaagaactgcagggtttaatactgttgatacggcaggattaactgatgccagtagtctgctgactatgttcttaatgtttattggcggaggttccttatccactgcaagcggtataaaaatcggcacattctgtattatagtggtagcgacattcgcctatttacacaaagaatcccatgtcaatttgtttaaacataatttgcctgatgaactaatcaaaaaatcctttgctttattttttaccagccttagttgtattggtattagtagctttttgctcttggcagttgaaccgcaatttcatttccttgatgttttatttgaagttgtttcggctttaggtacagtcggactttcacgaggaattactgctgaactttcaccgttcggagagtcaattttaattatcttaatgtttatcggtcgagtaggattgctcactatgatttatctcattatgcaaccgcactcaagtaaaattaaatatccaaaagaatatatacaaataggctaaaaaataaagggaataatttattcccttattttcctaaatttaatctgttttgcaccgcactttgctcaagtttaacgacaaatatacaaagtaattttcctctaagaatgaaaaaatttatgctaacaaagccaaaaactcattttcactcagaatgttaataccaagctcagtggctttagttaattttgaccccgcactttcccctgcaataacaaaatccgttttactcgaaacactgccgctaactttacagcctaattgcaacaaatattcttttgcctctgaacgccccattttcgtcaacgtaccggttaatacgacggtttttcctttcaaaggattgtcccgcacctctttaacttcaacgtcgtcccaatgaatgccttgtgcaattaaatcttttaccacagcaacattatgaggctcagaccagaatgaacgaatacgtttagccactacttcaccaacatcttgtaccttttgcaattgctcaaacgttgcattttcaaaagcctctagtgtcttaaaatgagttgctaaatttaatgcagtagtttccccaacttcacggatgccaagtgcaaaaataaaacgagccaatgtggtttttttcgctttagctaaacttgctaaggcattttctgccgattttgcccccatacgttctaaacgcattaaagtaacctgatctaatttaaataagtcagccggtgtatgtactaactccctttcaaccaactgttcaattaattttgcaccaatgccgtcaatatccatcgctttgcgtgaaacaaaatgtttaagtgcctctttgcgttgagctgcacaaattaagcctcccgtacaacgagcaactgcctctccctcaattttgctaataacggaatcacacacaggacaatttgttggaaaaataatagattttgcattttccggacgacgttcatgtaacacgccgataatttgcggaatcacatctccggcacgacgcacaatcacggtatcaccaatcgcaatatccaaacgtgctatttcatcaccattatgtaaagtagcattactcacagtgactcctgcgacaaaaacaggttctaattttgctaccggtgtaatggcaccggttcgcccaacctgaaactccacattattcaaaattgtcagctcttcttgtgccggaaatttataagcaattgcccatcgaggtgctttagaaataaaaccaagttgttgttgcaagtcaatatcattaatttttaataccgtgccatcaatgtcataacctaaggaactgcgtttttgcttaatagtgcggtagaaatccaacactttttcaatcccatgacataattgaatttcattatttaccggtatgccaatagattttagccattgtaaacgagcaaaatgtgtatccggtaattccactccttctgcaataccaataccataagcgtttaacatcaaaggacgttgaccggtaattttgggatcaagttgacgcaaagaacctgcagccgcattacgtggattagcaaatgttttttctcctttcgctaaagctgttttgttcagtttttcaaaacctgcttgcgacataaaaacttcccctcgcacctccaaacgagccggtggattatctgttaataattgcaatggaatattacgaatagtacgaatatttgccgtaatatcttcaccggtcgtcccatcgccccgagttgcagcctgtaccagctgaccgtttatatacaaaatactgactgccaaaccgtctaatttaggttcgcaacaaaatgttaaagaatgatgaacatgtatcaaacgatcttgaatacgtttgacaaaagcaaagaaatcttcatcagaaaaagcattatctaaggatagcattggaatatcatgtttaacttgagcaaaattacttaacggtttcgcccctactctctgtgttggcgaattttcactggcatattcaggatattgttgttccaacgcttttaattgatgaaataagcgatcgtattcactgtccggaatttgcggattgtctaacacatgatactgatattcatgatggcgtaatagttgtcgtaattcttcaatttgttgcttgatcataaaaattccttgcttcaagaccgcactttaaatagtggctcattatacacaatcacgctattctgcgtaaaaaattgcccctgaaaattcagaggcaataaatcaatagaaaagtgcggtctatttttacaaaataatactaccgatcaatgccaaagcaaaaccgactaaaccgattaatgtttccattacagtccaagtttttaacgtggttttggtatccatttccaagaaacgacttaccaaccaaaagccactatcatttacatgagaaagtacggttgcacctgaagcgatagcaatcacgataaaacataaatcaaattgacttaagcctgtggctgatgacaccattggtgcgatgagagcagaagttgtggtcagagcaacagttgcagaaccttgagctatacgaagtgcggtagaaattaagaatgccgcaacgataattggcatacccgtatccgaaaacatttttgctaatacatcaccgataccacttgcacgtaatacaccgccgaacataccgcctgcaccggttaccaatacgattgcacaaatcggacctaaggcgttatcgcagattttttcgatttgttcaaaactgcgttgttctttgagtaaaatgatagtcattaataggctaattaataaggcaataggtgttttgccgattaagcgtaaactttgtacccataatgtagaaccatcaattacttttgctactgctaaagtgtttaggaccgtgtctaacataattaaacaaagcggcaacagcaaaataaataatacttttttgaaacttgggggattttgaaccgcagtttcgttaattggagctgcatttaagaaagttttcggtagcggtaaatcgaattttttacctaagtaaagcccatataaataagtagcaaaataccaagtcggtacagctaaaatgaagccgacaatggtgagcaaaccgatatttgcacctaaaatatcaccggaagcgaccggaccgggatgcggaggaagaaatgcgtgggtgacagcaaatgcaccggcagcagggaacgcatagcggaataatgaaccaccgaattgttttgcaacactgaaaataatcggcaacattaccactaaacctgcatcaaagaaaatggggaacccgaataggaatgaggcgacacctaaagcgaaaggtgcttttttctcgccgaatttattgattaaggtatcggaaagtacttttgcaccaccggtaatttccaataatcgaccgatcattgcacctaagccgactaataaagctactgaggcaagggtattaccgaaaccgcctaataaggtcggcaggattttatctactgacataccggtagcaagtgcggttaataaactcactaaaactaaggcaacgaaagcatgaaccttaaatttaataatgagaagaagaagtaatgctatggaagcaatcaaaataaagatcaacataaaatttccctattaataaaattaaacagcagcaagcataccaccatcaacgaataacaaatgcccattaacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncataaaatatcctccaatatttctgttactggtaacatatttatttttctagattgggtaaagtttgtgtgtttgattttgtgatttacgtcacattttttctttatttttaatgattttttaaaaaagtgcggttataaaaataaaaatttaaaacaataaatatagatttaagtgttattggtaactttttaaaattttttcaggtacactaagctcaatagcgtatttattagaggaacaaaaaatgtcaaaaggaaaaagtattattttaatgggggtatccggtacaggtaaaacatcagtaggaactgaagtagcgtaccgcctaggattgaaattaattgatggggatgatttacacccaagagccaacattatcaaaatgagacagggacaaccgctcaatgatgaagatcgtatgccttggttggagcgtattcgtgatgcggcatttagtttggagcaaaaaagtgaaaagggcattattatttgttcagcactgaaaaaacaatatcgagatcaaattcgtgatggaaaccgaaacattaaatttatttatctatccggcagttttgaattagtgctttcccgtctgcaaaaacggcaagggcattatatgaaaactgaaatgttgcgaagtcagtttgctacgttggaagttccccaagctgatgaaactgatatttatcacattgatattgacgcaacttttgaggaaatagtgcagcgttgtgttgaagctatcaagcctcttttagattgatgacaagaaatgcttgggcgtagaggtgttatctaagacgtagattacagacaatatttttgccataaaagatagtttttgagctaatgctacgaaaaaatactcaaaccccaccgcactttgcaagtacagtggggttataaatagaaaaagcgtagtcgatttttaccagtatgcattgttattcctatgttttgttttaaaaataaaattctgcgtggtgtattattgacaaggcgttgcacaaaacaattcaagcgaaattcccacctttgcagtaaaaatttaattctcttggtgttattcttgtacgatctattctctctatatttgcatttttcctaaagcaaaactcgatctatctcacaaaaatattaacaaataatttacaattcaaaccgagcatgctaaaaagcaatcgtttgcaataaaaatattgcatacattgcatacaatacaacatcaatgacatcacacaggagcaattctatgaaaaaaatgaaagtcgtattgaccagtgcaacagttctacttgctacattgcttgccgcttgtggtgataataacaaagcgtcgaaagatgttactgcgagcaacgttgcggcaaacagcagcagtgctgaaagtgcggtaccagccacagtgcaaagcaaatttgtgaccattgctactggcggtgcttccggtccttacaatattattgcgacgacactgacaggtatttatagtaaaaatctaaaaactaattccaaaacacaaactactggtgcatcggtagaaaatttaaacttgatggcacagaaaaaagtggaaatggcgtttgtgatgagtgatgcgttaaatgatgcgttaaatggtaccggcagtttcaaaaataaaattgagaatgtggaacaaatagcagcactttatcctaactatgtacaaattgtcacctctaaacgttccggcattaaaaccattaccgatttaaaagggaaacgggtagcgaccggcgatcaaaattccggagtcgaagtcaatgcacgtaacttacttgccggttttggcatttcctatgcggatattaaggttgattatctcggttatgctgcagcggcagatgctctaaaagcgggaaccattgatgcggcgttcttaaccagtggcttgccaaattctgccttaatggaattgcaacaaagttttgatctgcaattggtctctatcccggctgacggaattaaaaaattagccgcagataaaccgtattttaatgcgatggatattccagcgaacacctatggcaatcctgaaccgattccgacagcggcaattaaaaatgccttggtgatccgtaaagagctcagcgaagcagatgggtatttattaaccaaaaccttctttgaaagtttgccacaattgcaaaccgcacaccaagcggcgaaaggcattaacgtgaaagaagcacaggaaggtgcagttgcaccattacatccgggtgcaaaaaaatattatgacgaagttaatgcgaaataattcgttattaagttggtaagcatgaagataatgcctcgtaacggttggtttgtgctggtgccactcgctgttattgggctttatcctgttcattttatatcagttaccacaaaacaaggcgaatgcatcattggtgatgatcattttgcactacgttggcgtcactccgtcgagcatcaattgtggtatgaacattatcaacgacaaggtgataacctccacctttatcaaacatggttacaaacatttggtgccggaacaccttctcaaggtgaagttgtcacccatgtgccagtgggctatgtcggttttaaacaagatgttgttttacccgaaataaattggattgtttcgcatcgtatggaagggactattttgcttgatgataaacaatttcccgtttatcaaacacttcctaattattctgcggtaacaatcaaaccagctaaatctgtaattgcaacgttgtggttaaggaaatcatgttatgactgattctgtaaaaattgacaccgcacttggtgccaaggaacaagagattttggaaaaatatgaccgtgaatcggtcactcgtcaatccagtagccaatttaataaagggttaattacgctggtttcggttttatattccctttttcatttatacaccaccttttaccccctaccgacgttaatccagcgtgcagtacacgtgggcgttggagcgatattaatcctattaatttatctggcatcgaaaaaacgtcgccaaggttctgttgcatggtatgactggttatgggttattgccggtatgagcggtatgctgtatctcatcaaccaatacaatgacattatgaccgtccgaggtggtattccaaatagcacagatattgtgatggcaatcatcactgtgctagtggtgcttgaggtaacgcgtcgcgttaccggttggattttggtgattttttccttgctcttcttaatctatccattcatcagctcaatggattttatgccggacagcctcctcactcgcccttatgacgtcggtgatatttttggtcagctttatttaaaaacggaggggttatattcctctgctgtgggggcttccgtttcctttattttcttatttattttatttggggctttcctaagtaaatcgggaatggggcaattatttaatgatttagccttagcgatcgctggtgataaacaagggggaccggcgaaagtagcggtaatttccagtggctttatgggcagtattaatggggcagcggttgccaacgtggtgagtactggagcgtttactattccattaatgaaaaaaatcggttatcacaaaaactttgccggtgcggtagaagccagtgcatccgttggtgggcaaattctcccgccgatcatgggagcaagtgcattcattatggcggaaacgacaggcgtaagctacggaactattgcacttgcagccttacttcctgccttactttactatctcggcgtcattgcacaagtccactttcgtgctggtaaacaaaacttaaaaggcgtccctaaagatcaattgccaagggtaaaagcagtgatgaaagcacgtggtcatatgctattgccgatcttagcccttatcatctttttagcacaatccgtaccagtaggatatgctgcctcttatactattgtgcttaccattttagtcagtcaattgcgtcaagaaacccgtatgggcattaaagatgtaattgaggcattggctgacggggcaaaacagtcgatttccgttatgtcagcttgtgcgacggtaggaattgtgattggcgtgatgaaccttaccagttttggtacggtaattacctcttctatcgtcacattaggtgcaggatcgctctttttaaccttatttttaacgatgattgcctccatgatccttggcatgggactaccttctattccagcatatatcattaccgccaccatggcagctccggcattggcaacctttgatgtcccggtattagtggcacatatgttcgtcttttattttggtattttcgctaatatcacaccaccggtcgctcttgctgcttttgctggtgcgggaattgcacaaggtgacccaatgaaaaccggctggcaatccttgcgtctagccctagcgggttttattgtaccgttcatattcgtttataatccgaatatgctgatgattgatgttaccaatgctgcggttattgccaaaactttccctctaccaagtgcattcgaaattattaatgttatcgtatcctctgttattggcgttttgggattatctgctgcggtagaggggtatctgaaaaatactataccaatatggcaacgtattattttagcaatcggttcgcttatgttgattattccggaatggatcacggatattatcggcattgctgttgttgtagtcatagcactacttaatgttcgccaatgtgactaacaattgttctgtgcatacgataaatgacataactaaatgtctaattaacttttttagatttgaaccaatcattaccccttgattttgcatagcttcacaaccggttgtggcggtttgggtgttagaatgtaataaaaaaggttatttcccttaacacccaaaatactcaaaccccaccgcactttgcaagtacagtggggttttttgttgtgtttcagcaagtttgacaaattaccactgataacctatcgacacggcaccggatactttgccttgggaattgctattaccttgcagtttcagcataaccttaccgttatcgctgatgcgagaataaccaatcgccaacgcactttcgccatcatgtcctgccgccgcaatcgcaaccatggacttgcccggcatagagactgatgccaatgccgccgccgcattcgctccggcaataccggcacgcaatcggcgatcggcatgatgtatttgtgtacgtaacgcattattttgaccatccacgtagtttttattgactgcaacaaatccacttgcatcaggtttgacatccggaattaaaatttccccacggttaccattgatgacgatattaccgttattgcctgataccatcaaccctgcatgggttgccatcaatgacggttcagcggctttgccttgtagcttaatgccatcgagggtgtaacttgctgattgaccggcatgatttcctttgcccataatacgggtaccctgtgcmktyacwammgyttcgctgtctrgactgctcrcttkyaaaccgttgctgtyyartcgagatttyytaccgtycacttcacgagtttcaaacgaagtcatgttyttcaactgrtcggacagtttgacgactaagcccttgccgtctgtttccaccttgatattgccggcggcggtgaggttgctgttaaacgtatcaccttcacctttaattgctaaggtttcgctgagttgtttacgcacttcaacaccatcattgcccttaaacttcaagccggatttcgctaccgcctgcacgtcagcaatggtggctacgttggttaaatccgcttggctatcaggtttcactaagtcagcaactttttcataacccttgtagttggcttcatagtcagcattggcttttgttaattctgtctgagcctcggttaaagcagtttttgctttccctagatcttctttagctttttcaagctgtttcttgttttcctccaattgagtttgaagtttctttttatcctcaccctcaggcatggcactcatcgccatttctaaaccgctcacggctaaagttaaatcggttactttttgggctgtagttgaaagttctttcgctttatcgcctattgctttcactttttcctcaacagctttggtgagtgcagtcgctttctcttgagcctcttttgctttaaccggatcagtttcaggatctgccagtcccaaaccactcgccacgttattcatcccgataggtgcggcagtcggttcggcacgaataatgactttatccgattccggtgtaacttcttgtccatcttgagaagtatattttttactttctgcatcatacttcgccccctctaactctttaggatcatagaacttaccatcacgtcctttgacaactttggtatagtcatcgccctcttggatatagaagtcaaacggtcgattgctgtccaaatcggacactttttcatccacatagtttttattcgccgcacttgaaccgtcagccgtggcatctaggtctttcaagcccgtgattacgccagtgcccgatttaccgtcagtgcctttagcaaacgccagcgtagctcccttgccatcttgaccgttttcaccctctgccactttcaagctcacgatttcttgaccactcttgtctttaatagcgacctcgccggctttcacctctgtcgtgtgcttgccattgcttaaaacattcgcttctgctgtttgatcattgaccaaaacctgatcatcgctgaccacagacattgtcacgccctcagccgttgtcacaaccgctttttccttatcgggatctgtattatccgtgatgatttgcgatgtcgccgtttgtgtatgagcgttacctgcctgatctttcaacacaatttcattgccggtaatgttagtcgtgttaccgctttcgccgttaaactcagcagatttcaaacctgtcaagtcctcagtcgtaccaatcgtcaccaccgctgtagtgttcgaggttttgcttggtgtactgcttgctgtgccggctgttgtcgtacttggagtagctcctgacgaagctgtactgcttgtaccacttttgccatttgtacctgcaccacttgacgaagtcgtacttgaagcgaccgcactatctgcccctgcaccgccatttgatatggttgttgtcggtgcggttgtcggtggtacactgcttccgccagttgcccccgttccttgtgaagccatatttgacgaaccggacgtacctaccgaagctgtagcatttccaccgccggcggtacttgcaccacttgcgagtgcagaactacccgcacttggttgtgtagtaccattttgagctaactctactttaatattcaaaccggcattaaatttcaaggtgtcgyygcgaccratttgataagttgtaccatcaccattcgccacattgaatttaaagctatctaacgcttgttcaaggtaggacttggtgattaagtcgttatcttccacccctttattaccatacatttgcggtgtagaaarwgtcactttgctaaatrtcggtkcgtctttaaasccgatttcgatnttngcgttgccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaaacgcacaatattaatggtcgaaccgagatagtgggtgccgttatttgtacctgttggaacatcaccgccgaatttcaagccctcgttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatcaacctcaatacccaatttattagctaaatccgccagttgtttacctgtaacagcgtcttttgawttatcatcaatttcaccatttgtgagatctttgagttttgactcattmargctgatttcttttttagctktttctaacgtgattttcgcccccatttcatctttaccaccccagatactgtttatatctttaaggttgttagctagattatgttgaattgaaccattttcggctactttgacttgaatattgtcattttcacctttcttaaagtccaagccatccgttagttttacggtttgcttatttgtgctattcgctttataggttatttttaattcatcaacatagtttttattgacagcatcatatttatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgttgcttcaaatgtttctttttttgtcgcttctgacccttgccccaaggcaatggaatcgccagcggcagtttttactgttgcaccttgccctatcgctactgcaccgacggcacttgcttcggctttagcactatgaccaataatcaccgcactttttgcacccttgccggcgtttgattttgccccaataagcacactttcttttgcagtttcagctatcgcaccattaccaatcnnnnnnnnnnnnnnnnnnnnnnnnnnnnnnnnnnnnnnnnnntcattggtaatatccaatgctttaatattgttccctaacgccacaatatccgtaccgtttttgattttgtttttattcccgatagacgctgtccaagctgcgttttctatctaagttccatctgctccgtttttacctttcacaaaaaccgcacctattgctatagaacttttagattctattaattctgttccactacctattacaaccacagcaccatttatttttttaaagttttgcgtaactttattattagaccctagtacaaacgaactatgtacatctacacttacattattacctatyacaacygcattttcwgctgtggctttcgtacccacaccaatmgctattgcnccttcngcckttgcwccgtcattntngtanttgytttttgactctgggcttgtcggggctttaaccgataagaaatgtaattttgacgcttctaattgcttaaagtttacaacgtcattttcagctactccatcagcaacgcctgaaattttaaccttatcgtcactagttttacttaaacttaacacagccccgccagctttaatttttgtgccaccattgaatgtgatttgattattttcatctttaccaatagaagttatacctttcaacgtactatttagtgagatttccaactcttttttcgtaccatttttagcagttgtggtaatgtttttgtgtgaattttcttctttacccttaatatttaatgcatcttttacagcatattctccactatcagcagttaccttaaaactagtggctacatttttaaatttatcatccacatattttttattaacagcctcattatctgttttaggagcatttgtaatagttacttttttaaagcttggactatccgtcattccaatcttaaatattgctttctcattacttgacttatcaagttgtacctttaagttttgatccttatgagtatttccaatatctccagcttttatctccaatgtcgaccctaaatagtatttactagtaccattgttattagttgttccatcactaaacttatacccttgatttatagccttaattgtttcatctaatgcgtctttaaaattatcaggaacaccttttttacttgtcggagttgagatatattctacagccgtaaatgatgatttcttaaactgcttattatcaacttctacccctatcacatccttcgccaaatcagaaaacacctttgttacagcatataattgacttccgttaatagcgtctgttgaattctcactcacatctcccgctgctacatttttaataatacgttcttggtttgtatctcctacgctgaaaatggtttttttactttcttctttattatcaggacttactccgcctttgaaagtaaattcaacaccatttatttcggctttgtttttagcctcctgtttagctgttaccttagatccttttcctattgctaccgaatcttctgctacttctgcaactgacgctttatatcctatcgcaattgagtcttttccttttgccaggcttcctttgtagttagattcttctatttcttgctctgataaattagcgacctgatctttttttgccatatctgtctcaacagcttgtgtaatttcctttaattttgttaataatttattactatcactaactgtttcttttcctaagtcctcaacaatttttttaatagtacttgcttttgttgctatttggggattacttttttctaatgcatctaattccttcttaactttatctaatgcttcctgtttaaacgtttccttgccatttacttttctatttaataattttgcatattcacccgccaatttaacataacgttcataattttgttttgcttcttgaccttgtgctatttttgcactatcgccacttttttgctccacaccaaaataaggcgttaaattattttgtttattatttaagtctattctggtttctaaggcttttaattgtgcaacgttcacggcgtccgtatcttgtgaaccggcagcgacatttaccattcttctctcgtatccgttatatccgacagaaataacccctacattcgctgaagttgggataataattgctccctcgggtgtatatggatcggactttgaatgttcataatccgtttttgatttataacccagtgccactgaattttctaaagtagcggttgcttcattccctaatgctattgaagatttttcaagagctctcgtaaaacttcctaacgcaaatgcattagcctcttttgcaaaggcaaatcttccgattgcaacggtactgtcttctttggcgtaagcatatcttccgattgataatgcgttgtctccaagagcaacagtatacgaccctattgcgattgctccttggttatgtttacctttattgtcttttgattgctcagctttttcttctcccgttcctctttgttttgtcgttttaggtttgattgaagttctgttgtgttggatatcttttgtgtttcctaattcataaaatttatcgaaaaaatatttacctctatactcgtctttgtttgcattatcagtaaataataatttactactaccttcatctaatcctttgccggtaaaattttcgtccatcgcgatatttgccaatgcatagttacccatcgccaatgaaccgctaccccctgagtatgagtccgatccgtacaccatagaacccgcatttactgcctgtacattcgtacctacccctacagatctatcagcatagacataagaatcattcccgaaaactaatgaatttctaccaaaagctatcgtatttgttcctatcgcggctgaatagtctttatacgcaatcgcgtacgttccaagtgcggtcgaataatttccatatgcaacacttcttccccctattgctattgagttattacccctagcccatgtatgggtttttttgtttctatcagtgtcggctaaatatttttcatatgctttttctagatatccattatatttttccatccttttataatcgtccatctgttcaatgtttttcggcttttcaattggatttaagtttccattacttaatttttcataatattgatcgtcaattaaaacgtaataatccttgtgattacttttggtttttcttatataatatctcccgttccaaccaatagtaaatccatcatcactaactaaattcccatcaccattaacatatttatttttattagtattttyctcaataacatcagtaccttcaaataatttattataatcaactgctgcatattcacctgtatagttaaaattagccgcattatctagaaatatagtaaatatttctttaggaagtggtttagcattctcaccggaaatattatccgaccctatagctatactgttagaaccccgagcaacagtatcattccctaacgacacagattcattaccatacgaaaaggctctatatcccactgccgttccttggtggctgtcagttatattagttgaatcaaggtttttccctacaatagcacggtaacctatagcagtagcatcatttccaccaccaactgcacgagatcctataactaccgtttttttgaaatctttattggttaatnnagtatttgcccctgttttgtttgcaccatcggctaataaaacaacttcattcgtgttattaacgttacttctttcataccaaacagacgaaggcttattatcaccacctggttctctattaggattaacgtcaatccacacattcaccccatatgccacactcgataacaactcactcatcaataatgccaatggcagaatcttaaacatgcctaaaaacacaccgcacttcggctgacgccccgacgctccctcaacacggctcgccacctgacggttattcgctaattcagacacaactttcgtttgacccgttgttacatcgtatttggttttgaagattttgttcatattctttactcgctttaaaaattatctgttaattacttattaagtggttattgatcgaatctattattgtttatttattatctcttactgattatttattaaactttagagagataggttataaacctaaataataggcgatgccttgctttttaagacaaagcagaaaaaggcgaataatactttcgccgaaaggttgaggttgaaataggtgatttttaagatattgtttgaacatgtccaacctctcaaaattaacttgaaaggttgattttaggcaatatactaggctgtaggctgtaggctgtaggctgtaggctgtaggctgtaggctgtaggctgtaggctgtaggctgtaggctgtaggctgtaggctgtaggctgtaggctgtaggctgtaggctgtaggctgtaggctgtaggctgtaggctgtaggctgtcattttttccgttctatttttttgttaagtaaaagtaaaatttgtcgtattttatcttgtatttatttgtaagaaaagcgtaaattcattattttaatgtcggggcggattatatccgctctttaatgttttgtttaatgtgttttgttttctgtttgggttttgacttgcacctcaaataaaattcggagaaaatatcggcttttagtcagtataacaaacgatcatgtcatattctcaacaagtaaataaacgtcgcacttttgcgattatttctcaccccgatgcggggaaaacaacgattacggaaaaagttttactctatggaaacgctattcagaaagccggttcggtaaaaggcaaaggttctcaggcacatgctaaatccgactggatggaaatggaaaaacagcggggaatttctattactacgtcggtgatgcaatttccttatcatgactgcttggtcaacttgcttgatacaccggggcatgaggatttttcggaagatacttaccgcactttaactgcagttgatagttgcttgatggtgattgatagtgcaaaaggggttgaagaacgtacgattaaattaatggaagtcactcgtttgcgggatacgccgattttaacgtttatgaataagttggatcgtgatattcgagatccgatggaattgcttgatgaagtggaaagtgtgctgaaaatccgttgtgcccctattacttggcctattggttgcggtaaattgttcaaaggtgtttatcatttgtataaagacgaaacttatttatatcaaagcggtcaaggacatactattcaggatgtgcgtattgttaaagggttaaataatgctgacttggatagggcagtgggcgaagatcttgctcggcaattacgtgatgaattggaattggtcaagggggcgtcgaatgaatttgatcatgatttatttattcgtggggaattaacgcctgtttttttcgggacggctttaggcaatttcggtgtggatcattttcttgatggcttgacacaatgggcacccgctccgcaagctcgtcaggcggattgtcgtttagtcgagagtgcggaagaaaaattaacagggtttgtgtttaaaattcaagctaatatggatccgaaacatcgtgatcgggtcgcttttatgcgaattgtttcgggtaaatatgaaaaaggtatgaaactgaaacaggtgcgtttggggaaagaggttgtgctttccgatgcactgacttttatggcgggtgatcgttctcatgcggaagaagcctatgccggcgatattatcggcttacataatcatggcactattcaaattggtgatacctttacgcaaggtgaagatctgaaatttaccggtatccctaattttgcaccggagttatttcgccgtattcgtttgaaagatccgttgaaacagaaacagctgctcaaaggcttggtgcaactttcagaagaaggtgcggttcaggttttccgtccgttaaccaataatgatttaattgtgggggcggttggtgtactccagtttgatgttgtcgtttctcgtttaaaatctgagtataacgttgaggcggtgtatgaaaccgttaatgtggcaacagctcgctgggtagaatgttcagaggcgaaaaaacttgaagagtttaaacgtaaaaatgaacagaatttagcgttagacgggggagatagtcttacttatattgctccaacgatggtaaatcttaatcttactcaggaacgctatcccgatattcagttttttaaaacaagggaacattagtctttgatatgatagacaaaagagcggagatatttccgctcttttttgttgttcaaataggaaagtttgctcggtttaaatgcggtttaaagcgttgtgcctattttcaactcacattaatactcttgaacttcttcgtgttttcctaccgcacttttgatagttaattgcacttcagtagaaataattctatcgagaatatcgctaatgtcatttaatttctccgttatagcgacgccatttttatcaaaatatccgttggatcttaagctaccgataaaagcggaaaagacggctttatcgaaaaattccggtgcattaatgccatgtaatacagataaccgctgtgcaatagattggctttctttctctaaggtcgctttggcaatattcggggtatcttgcaagatactgacggtaatataataacgttgtaaaatttctcgaactcccgccatccataactgtaaaactcttacacgttctttattgattgaaagaagattttctgcacacagaattaatttttgacgtgtaaattcctcaataattttttcaacatattcatctaattcatcttgtgaaaagtgtaaaaataattcctcttttaagaaagggtaaatttttcgagctgcatttgataccaactctttttgtattgcaccatgatgaaaaatgatacttgcaattaaagaaggtaaaacaaaaacatgttggatattattacgataataggtcatcaatactgctgctgaacgttctaaacgcaacatttcaccaaaattatctttttctacgataagtccgactcgttctaagtttaatacatgagtgagcatttcttccggtgtatcagtcggtacaataatatcgttggaataaggggcgtgttgtaaaaagcgttgataacttttcagttgttccaacagttgttcacgagataaagcacgttggcgagaagacaaaagtgcggtgcccgttaagttcattgcattaattgccgctgctttgttgatattgatcatgacttgatttgaaatggcattaactgcagggttaaaccattgagaatgatcttccggctggctatctttccattcaggaaaatgttgatttaagtaattacttaatgtgataggttcggcaaaatttacataaccttgccctaaattgcgtaatttgcggataacacgcaagaccaaaccggcgttttctttctcttttgccgccccccgcaattcttttgcgtaagtatctacctctaatacatgctcatagcctacataaaccggcacaacggaaattggtcggatttggttttgttgtaaggcttgtacagtcatagacatcatacctgttttcggggcaagtaaacgtccggttcttgagcgaccgccttcaataaagaattccacagagtagccacggtgaaataattctgctaaatattcacggaaaatggttgaatataatcgatttcctttaaaggttcggcgaataaagaatgcacctcctcgacggaacatcattcccaccggccaaaaattgaggttaatacctgcggcaatatgtggaggcaccaacccttgatgatatagcacataggacaataacaaataatcaatatgactgcgatgacaaggaatatatacaatttcatgtccttctaacgctaatttacgtacacgttctgcattttggacatcaattccttgatataatttattccataaccagcctaaaaaacgatctgcaacacgcaatccctcgtagttcacattggcggcaatctcatccaatatcttatatgcttctttacgtgctttttctttgctgattctcttacttttcgcttcatctgcgatggcattgagaattgccggtgattgtaataatttattaaacattgcttggcgattaggtaagcgaggacctgtagcggacattctttgtttggcaaaatggatttttgccactcgagcgagttttaaagcaatacttgcatctgttccatattcatcagccatatagcgtaaagaaaccgcttgtgaaaaacgcacaaaagtatcacgcccaaaccaaatagccacagctgttttttggatactatttaataaacgaagttttggtaagccaacctgcttttcatgacccggagaacgtccccaaagtacggaaacaggcactaactgtacatttaaatcaggtaaagagcggtgtaattcaaggtatttttcaactatctgaatagtcgctgacttagcacctttcgatttaaaaaaacgtctaccttcgtctaaaaatacataacgaggtaaacattgcccccccaattcattctcttctaagggatcaggcaatcctacgcttaagcaatttctacggataataattaaatctgtttgtgaagtgtaaggtaataaataaatgatcggttggctaatatctaatgataattcttcgataggttgttgcggtatagggttatttttaactaaaaaagagagagggacggacaaaagattacgataaaaattaagaatacttgacataacaatttccattaacttattaggttgattggctaatgaatactattctaacaaaaaaaatatttttttattaataaattaatttattgaaactaaagattgatgtaattttatttctgtatataatgtcatatattctgtatataaaaacaggggttagtatgagttcaataaaatcattaacgacacgacaacaggaagttttcgatctaataaaacgtcatatcgaaagtacaggaatgcctccaactcgagtggaaatatctaaagaattgggatttcgctctccgaatgcggctgaagaacatttaaaggccttggctcgtaaaggtgtaattgaaattgtatctggtgtatctcgtggtatcaggctattaacggatatagaagaaccggaaaatgaaggacttccgctgattgggcgagttgccgccggtgaaccaattttggcggaacaacatattgaagcaacttatcaagtcgatgctaatatgtttaaaccgcaagctgactttttattgaaggtttatggtcagtctatgaaagatattggtattttagatggtgatttgttggctgttcatagtacaaaagacattagaaatggacaaatcgttgttgctcgaattgaagatgaagtaacagtaaaacgctttgagcgtaaaggttcgattgtttatttacatgcggaaaatgaggaatttgagccaattgtagtagatctaactcagcaaccttactttgaaattgaaggtattgccgttggcattattcgcaataatgcttggatgtaaacatgacatcatgcagtaaatttgttatttaaaaacgagtagcggaacaaaaataagccaacaactatttgttggcttatttttaactatctagcataaatctcagcttcggcaaaaaaataggcaatttcacgttgtgcattctctaaactatccgagccatgaacggaattttgggtttgattaatagcaaattcataacgtaatgtgccattttctgctatttccggattagttgttcccataaaagtgcggtagtcttttaccgcattttctttttgtaacaccaaaacaactataggggcagatgtcatgtatttaaccaattcagtaaaaaacgctttattgcgatgttctgcataaaaaccttccgcctgttcttgatttaaatgcaacatcttcatagcaatgatttgaaatcctttgtcctctaaacgagaaatgatgttacctattaaatttcgttcaactgcatcgggctttataatcgctaaagtttgttctaatgtcataggtctctccattattcagctttatttaataaaaaattcgccaaagtttgtacaccgattcccgttgcacctgttgcccataagtcacttgctgatttacgataagttgccgaacaatcaatatgtaaccaattttcttgataattttctacaaaataagataagaacgccattgccgtacttgcaccggcacccattggaacagtcccaatattggcaatatctgcaaaggatgaattaatttggtgacgatgtaattcgtcaaaaggcaatcgccaaaacggttcttttgtactctttgcacaatcgaaaaactgttgagtgagttcgttatccattgaaagtatcgcatgataatcattaccaaccgctacttttgctgcaccggttaaggttgcacaatcaagaataaatttaggcttcgctaaatccgcatcaattaagccatcggcaagtaccaaacgcccttcggcatcagtattaagaatttccgcactgataccattgcggtagtgaataatatcacctaattttaaagcgttgtggctcaccatattttcagcacaacataaaaatagtttaactcgtttgttaagccctccggctattgccatacctaatgcacccgttaatagtgcggcaccgcccatatctgttcgcattgtactcatgctatcacttggtttaatgctgtaaccgccactgtcaaaagtaattcctttaccgactaaacaagccagtaccggtgcattttcatttccggtaggattaaaatccagctgtaacatagctggtaaattttctgagcctttacccacttgccaaatcccttgatagtttttttcagcaagttcttgtccggaaataatttgaaaagataccgcactttcgtcagcataaagacttgcttgttcggtgataaattgtgccgcacgctttgcaagttcaataggggtgataattgaagaggggagattaataatttcacgcacaaaatcgctgcattgaattcttgccagcaattcagcttgtggctcgtcctctaaatgaggaaattcaatagtataatcttgtttagcggtataaaagccttgatagaatgcccaacaattttctaaatcccattctgatccaataagttcaacttcttttattccttggttgcgtaattttcgagcggctttttgaattaaagaaatgtcttggttacgtgtcggatgatgaatgatggcttgatcgtgagtaaaactgattaaagcttttttcccccattgttcttttgctggtgaaatttctattttaatttgcatactttatccttaaatttacttgataaaaaaactgatatagatggcactataccagtttttattgaggtaacaagaatgaatagggagaatgatcagaaataaagtctaattagcgtaaaaaagcaggaatgtttttttcatactctgcgattttatcttcatgttgcaaagtcaatcctatattgtccaatccatttaataagcaatgacgacgaaattcatctaattcaaaatgataaattttatttcccgttgtgacggttaaattttctaaatttacatgaatttcacaacctttatttttccatacccattgaaaaatttcttccacttcttcttcattcaaacgaatgggcaacatatgattattcaggctattattatagaaaatatcagcaaaactaggtgcgatcatgaccttaaatccataatccgccaacgcccaaggtgcatgttctctagatgacccgcaccctaaatttttgcgtgcaagtaaaatcgttgcaccttgatactcgggaaagttcagcacaaatttaggattaggtactgtaccttcctcatcaagataacgccattcgtggaataagtgttttccaaaacccactctggtaatagcttgtaaaaactgttttgggataatcgcatcagtatccacatttgcggcatcaagaggaaccactaaacctgaatgttgtttaataccagccataaatcttccttaatttaattccatataacgaatatcaacaaatttaccgaagacagccgctgccgctgccattgccggacttacaagatgggttcgtccgttacggccttgtcgcccttcaaaattacgattactggtcgaagcacaacgctcccattcaccaagtcgatcatcattcatacccaaacacatagaacaaccgggattacgccattcagcaccagccgcaataaaaattttatctagcccttctttttctgcttgttctttgaccaatcctgagccgggaacaacaagtactcgttttacgttatccgctttttttcgacctttcattactgtagctgccgcacgcaaatcttcaatgcgggaatttgtgcaagatccgataaatacttgatcaacggaaatatcttttaaatcagtttccggagataagccaatataagctaaggctttttctgcggaggctttggtgacgggatcttgcatttctgccggattaggtactttctgatcaataccgataacctgacctggattggttccccatgttacttgtggagcaatgtcttttgcgtctaatatcaccacagtatcaaactctgcaccttcatcggtttttaaggttttccaatattctaccgcactttcccagtcttttccttttggtgcataaggacgatctttcaaataagcgaatgtggtttcatcaggtgcaatcagtccggctttcgctcccatttcaattgccatattgcaaactgtcattcgtccttccattgacaatgcacgaatagcttcaccacaaaattcaacaacatgaccggttccccctgccattgtggttttaccgataatggcaagaataatatctttggcagtaatgccttttgcgacttcgccacgtacttcaattttcatacttttggctctggcttgttttagtgtttgcgttgcaagaacatgttccacttccgatgtaccgataccaaaagctaatgcaccgaaagccccatgagttgccgtatgggaatcaccgcaaacaatcgtcatgcccggtaaggttaatccttgttccggccccataacatgtacaattccttgctgtttactgttcatatcaaacaaagaaattcctgttgctttacaatttttatctagctctaaaacctgaattttcgcttgccctgttaatttgtttacatcacgcacttgagtagaaatactatgatccattgtgccgaaagttttattcacttgacgaacctgacgacctgctacacgtaaaccatcaaaggcttgcggtgacgttacttcatgaattaaatgacgattaatgtacaaaatcggtacttctcccggtgcttcatgtacaatatgagaatcaaataatttttggtagagtgtttttttcatatttattccgttaagtttttttcactaattaggtaagtgcggtagaaaacgagaaattttggctaaatttaccgcactttatttttcattctctattgcttaaattgcgtttacaattaagtctcccatttcagctgtggaaattggcggatgttcatctgctaaatctgcggttcgataaccttgagaaagaacctgtttcactgcgttttctattgaatccgccgcttcatttaagttaaagctataacgtagcatcatggcagcagatagaatttgagcgattgggttggcaatgcctttgcctgcaatatccggagcagaaccacctgccggttcgtaaagcccaaaaccatgttcatttagactggcagagggtagcatacccattgagccggtaatcattgccgcctcatcagaaataatatcgccaaaaatattagagcaaagtaagacatcgaaaaattcaggtcgtttgatcaattgcattgtcgcattatcaatataaatatgatccaatgttacgtcaggatagttcttggcaacctcattgaccgtttcacgccataataccgagctgattaatacattggctttatcaacagatgttacatgtttacgccgtttcatcgctgtttcaaaagcaactttagctatacgttcaatttcatatttgtaataaacttctgtatcaaaggcacgagtttgcatttcctctccatctcgtcctttaggttgaccgaaataaatgccgccggttaattcacgaacagtcatcatatcaaatcctttggcggcaatatccgctcgcaatggacaaaatttttctaaaccttggtaaagtgtggcaggacgtaaattacaaaacaatttgaaatgtttacgcaatggtagtagtgcacctcgttcaggctgctgattagggggtaaatgttcccattttggtccgcctaccgagccgaataaaattgcatcactttcttcacagccatttaatgtagaagcgggtaaaggcgtaccatgattatcgatggctattcctcccacatcaaaagtgcggtaatttaatttgaaattatattttttttgcactgcatccaatacttttatagcttccgccataatttcaggaccgataccatccccacttaatactgcaatagtataacttttcatgatttttcctctttacatcaactttactgtgaaattttatgcgattttaaatctgccactttattggcacgataaatggcattgattgcatgaattaaggcacgagccgaggattctacaatatccgttgccaatccgacaccatgaaaacgtcgccctttatgttcgacaacaatatccacttgtcctaaggcttctgctccctcaccttttgcagtcaggttataatgcaacatagttatatccatatctgtaattgctaaaatagcgttataaacggcatcaacgggaccatttcccccatttgaaacttggctaatttttttaccgtccagctcaacttgcacaaaggcagaagccggtaaattactgattgtttgagaagtaataacatccaaacttagccgatcttcatcaccctgttgcatatcaataaatgccaatgcttccaaatcataatcaaatacttgcccttttttatcggctaattttaaaaatgcggcgtataatttatccaaatcataatcgttttgttgataacccattgcgtccatatggctttttactgctgcacgtcctgaacgagcggttaaattcaatttttcttttttcaatccgatggtttccggcgacataatttcgtaagtatttttatttttaaccataccgtcttgatgaatacctgaagaatgtgcaaaagcatttgatccgacaatagctttattcggctgaattggcatattacacaactggctaaccatctgactgacacgatgaatttcttgtgtattaattcgtgtatctaagcccttaaatatatcttgacgtgttttaattgccatgactacttcttccaatgcagtatttcctgcacgctccccaatgccattaatggtacattcaatttgtcttgcaccgttttgtactgcggtcaacgaatttgcagtcgccatgcctaaatcattatggcaatgcaccgaaattactgctttatcgatattcggtactctgttcatcacttgatcgatgatattaccgtattcggttggtaaacaaaaacctaccgtatccggaatattgactgttgttgcacccgctttaattgctgcctcaacgatgcgacaaatgttgtcaacacctgttcgaccggcatcttcgcaggaaaattccacatcatcggtataacgtctggcacgttttactgcttgtattgccatttccacgacatcatcaaaagtgcggcgtaatttagcttcgacatgcaaagcggaagtggcaataaacgtatgaatacggaacgcttcagctacttttaatgcgtcagccgcaatatcaatgtctttatccactgcacgagacaaagcacaaacacggctgttttttatatgacgagcaatggtttgaacggattcaaaatcccctgctgacgatactggaaaccccacttccattacatcaacacctaaacgttccaacgccaatgcaatttgtaatttttcttttactgttaaactggcttttaatgcctgttcaccatcacgcaatgttgtatcaaaaataataatgttgttttgcataactctttccttcttattttgtatgttgccatctgcaaagtgcggtgatgttttattgattttagaaacaaaaaaacccgcattctacttgtgcgggtcaactgacatgtttaactatacttctttgttccacaatttatccgcacaagaaatgtgatagtcgtaaattgagtaacagagaaagaatgttaaacataaaatatcctaaaaataaaccaagatgggtttatattacgagtttaaaatgatgtgtcaaatgattttttagtgttttataccaaataaaaggttattcaaaacataattttgatacataaaactaacttttaataatttaatagtgttaaaatccacgtcattaaaaaattttaattttttctaccgcactttagctctttcatagtaatgaaagtaaatttgtgtttttttgggggttctaaaaaataacttatcggcgttctttgagttgattttgttttaaatcaaataatcctatcatatacaactaaagagttatgcttttaacgtttcattttttacaccatgagtatagcttatgatagaatgcatctccgaaaatgtttaaataacttcttatgcaaaataatcatctacaactggaacaacttgcctgtcagcgtggcgataagattttgtttactgacttaaatttagatgctaagtcgggagattttgtgcaaattgaaggacacaatggcataggaaaaaccagtcttttacgaattattgtgggacttagtttccctgctaaaggtaaagtgcgatggaataagatcgaaattaataaaaatcgtgaagaataccagcacaatttactctatttggggcatcttgctggaattaagcctgaattaagtgcttgggaaaatttacagttctatcaaaaaattggtcattgtcgacaaagcgaggagttactttgggatattctacagaaagtggggttattgggtcgagaagatttaccggcaggtcaactttctgcaggacaacaaaaacgtattgcattagcaagattgtggttatcaaatgcggcattgtggattttagatgagccttttacagctattgataaacaaggtgtcaacgttttaactcagttgtttgaacaacatgtggaaaatggcggtattgtgattttaaccagtcatcaagagattccgagcaataagttgcaaaaagtgcggttagatcaatacaagttttttgatcaagggaatatggcatgatttttgtacaaattatcaaaagagagttaaaaattgcttgtcgaaagcaagctgagatcttaaatcctttatggttttttttgattattttaaccttgtttcctttggttattggtccggatcctaagctattagctaaaatagcccccggaatagcttgggttgccgctttgctatcggcattactttcatttgagcgtttatttcgtgatgattttgtggacggttctcttgagcaattgatgttgacagcgcaacctttagcgatgaccgccttggcaaaagtcattgcacattggcttttaaccggtttaccgttaattttactttcgcccattgccggactattactttcattggagttgcatatttggtgggcattagttttaacattgttgttaggaacgccaaccttgagttgtttgggagccattggtgtggcacttacggtagggttgcgtaaggggggcgttttgctgagtttattagtcttacctctatttataccggtattaattttttctgccgctgttttagatgctgcaacattaaatttatcttataacgggcaactcgcaattctgggagctatttttgtttcagtggcaacactttcacctttcgccatttcaattgcgttaagagtgagcttagaccagtaattaacttagtgaagatttgttttttaaataacatagtaaggacaacatgatgtggaaatggttacatccttatgcaaaatcggaaacacaatatcacttatgtggtaagtttgttcctttgtttgcaacagtatctatacttttattaataaccggcgtaatttgggggcttgcttttgcaccggctgattatcagcaaggtaacagtttccgtattatttatatccatgttccggcggcaattttttctatgggaatttatgtgtctatggcaattgccggagtgattggtttagtttggcaaattcgccaagcgtatttgagtattctcgctatggcacccatcggtattgtgtttacttttttgacattggtcactggagcaatttggggtaaaccgacttggggaacttggtgggtgtgggatgctcgtttaacttcttccttgattttattctttttatatttaggcgttatcgcactttactctgcttttcaagatcgtttaatcggtatgaaagcagcagcaattctttctattgtgggggtagtcaatattccggttattcatttttctgttcagtggtggaataccttacatcaaggggcaagcattacaaaatttgaaaaaccttccattgcaacacctatgttaattccgcttattctctgtattttcggttttatggcattaacaatgtggtttactttaatgaattatcgaactcaactgttaaaagatgagagcaaacgcccttgggttaaagcattagtaaaataggagtttattatgttttttcaaagttggagtgattttttttatatgggcggtcatgggctttatgtctggctatcttatgggatttctttccttgctattataggattaggcttgcaaaatatttatcttcgcaaagccctatttaaagaaattcaacgtgaacaattgcgttcagtgcgtcaaaaaaatacgcaagctgaaaacaatggagaaaacctatgaacccaagacgtaaatcaagattatcggtagtactgtttattttcctgggcatatccgttgcctctgctttagtgttgtatgcgttgcgtcaaaatattgatttgttttataccccaacagaagttgtgaatggaaaaaataacgaaagccataccaagcctagtattgggcaacgtattagaattggcggaatggttgtggaaggaacggtagaacgtgatcctaaaagtttaaaagtcagatttgacttaaatgatattggaccttcagtaacggttatttatgaaggtattttgcctgatttatttcgtgaaggacagggcattgttgctcaaggtgtacttattgagccaactgtactgaatgcaacggaagttttggcaaagcatgatgaaaattatgttccgccggaattagaagcacaaatgcagaaaattcataagcctatgggcatatcggatctcaagaatgaaagtgatcgtgatcgtcaagaaaaacaatttaaagaaggtaaccaatgatcgctgaattaggcaattatgctctggctttaagtttagctatttctgttttattatctatttttccattatggggagcggaaaaaggcaatgtgcagatgatggctttagctcgcccaatgacctatggtttatttgttagcttaactgtttcttttgttgcacttttctatttatttctgacaaatgatttttcagtacaatatgtggtgaacaattcaaataccaacttacctttgcaatatcgtctatccgctgtttggggctcccacgaaggttctttattactttggatttggctattgactctttggagtgcggctgtggcttttttgagtaaacaattaccccaagaagctgtggctcgtgtcttggcaattatgggtattattacgattggtttcttactatttgtgatgtttacttctaacccttttgaccgcactttccctgattttcctgttgagggaagagaattaaatccattattacaagatattggtctgatttttcatccgcctttactttacatgggctatgtgggtttttccgttgcttttgcttttgctattgcatcattgatgacgggaaaactggataccgcatgggcaagatggtcccgaccttggacaatggctgcttgggtatttctaacattggggattgtgctgggatcgtggtgggcatattacgaacttggctggggcggttggtggttctgggatcctgtagaaaacgcctctttaatgccttggcttgccggtactgcattgcttcattctcttgcggtaacggaaaaacgtggttcatttaaagcatggacagtattgctggcaattttggctttttcactgtgtttattaggtacttttttggttcgttccggtattttggtttcggtgcatgcttttgcctctgacccaactagaggtttatatattttagcttatttaattgtagttattggcggttcgctagcgttatacgcttataaaggcaatcttattcgcacaagaaacaatgctgaacgttattctcgagaaactatgttgttaatcaataatattttattaatgaccgcacttagtgtggtgttcttgggtactctcctgcctttagtacacaaacaattagggttgggaactatttctatcggctctccattttttgatcaaatgtttttattgatcatgattcctttatcacttttattgggtgtcggacctttagtaaagtggcgtcgagaccaattctgtgctattcgtcttccggttatcatcagttcaattattatgcttattaccggatttgttttaccttattttttacaagatcgtattgcagtgagtgccgttcttggtgtcatgatggcaatgtttattcttcttctagcactctatgaattgcagcaaagagcaacgcataagcatagcttttggattggcataacaaaattgtctcgttctcattggggaatggttttagcacatttaggggttgcgatgacgatatggggaattgcttttagccaaaattacagtattgaaagagacgttcgaatgaatgtgggggatacagtaaaaattgcagattatgaatttactttccaaggtatatccgatgtcaatggtgtcaattacttaggcggaaaggcacaaattgacatcagtcgaaacggtaagtttgaaaccacgttgtttgctgaaaaacgtttctatacagtgagtaaaatgacaatgactgaagcggctattgattgggggttatctcgagatctatatgttgcactgggcgaaagtttaaatgatggttcatgggctttacgcttgtattataaaccttttattcgttggatttggctgggaggtatatttatggcattcggcggattactctgtatatttgaccgacgttatcgttttggaaaacttctaaaacaaggataagttatgaataaaaaactttatataccattaattttattcctcggactagcctttgctttttttgtgcaactgcaacgtaatgcacaaagcgataatccaaaagcattggaaagtgccttaataggtaagtcggtgccaaataaactgctaactgatttactgacagataagcaatatgacaatcgtctattcaaacagggtaaacctttgctcgtcaacgtttgggcaacttggtgtccaacttgttatgcggaacatcaatttctcaatgaacttcataaacaaggtattaacattattggcattaattataaagataaaacggataaagccataaaatggatcaaaaagttaggcaacccttatcaagtaattgtaaaagatgaaaaaggatcttttgggctggatctcggtgtttatggtactccggaaacgtttatcgtggatggaaacgggattattcattaccgccataccggtgatataaatgaacgtatctggaaagaaaaaatacagccaatttatcaacaagtaagtgagaaaaaatgatgacaaaattacgttattttctgaccgcactttttctcagtttttcagcacaagctgcgattgatgcacttaattttacctctatgcaacaagaaaaagattatcacagcttgactcaagaactgcgttgtcctcaatgtcaaaataacaacattgctgattccaatgcttcgattgctgtagatatgcgggcaaaagtgtatgaacttttacaaaaaggtcaaaataagcaacaaattatcgattatatggttgaacgatatggaaattttgtgacttataatccgccggtaacaggttcaacaatcattttatgggttgctcctttggctttgatgattcttggtgttgttattgtgctacgccgtaaatccggttcatccggtaaaagtgcggtagaagctcagccaaatttaactcaagaacaacaaaagcgtttagaagaattattaaaagaacgggaataaaaaatgattttttgggtaatttgccttttattaacattagctattgcatttatttgtttttatcctctgcttagaaacaagacagaaaaatcaaccaatttaaaacgagatgaattaaataaggccttttatttcaataggttgaaagaaattgaggaagacgaacaatacggtttattagaaaatagtcaagagtttaaaacagaattacaacaaacgttgttggaagatattcctgaaaaaatggctgttgagaagagcaataagcaatacggacaaatttggtttatttccggttttttgactttagcgattattgctcctttaacttatatgagtgtaggttcttggcaatctgagataatgttagaaaaaacttacgaaaaattaccgcacttttatgcaagagtaaaagaggaagcaaacaaaccgctaaatgaaaatgagctacaacaatttgctgttgcactgcggttaaaattacaaaaagaacccaataatgcggctgattggtggacgctaggacaagtggcaatgaatctggaaaaagcacaacttgcttttgatagtttttctcaagccaataaattagcaccgcagaatattgaatataagctatcacttgctcgaattttgatgttttcacaagatcaaattgatcgtcaaagagggatgaatttattaaaagaagtgttgcgtattgatcatactaatatgcaagccttaagtttgcttgctttccagtattttgagtcggaagattatcaaagagccgctgtaacttggacaatgatgcttcggttcatgccgaaaaatgatccaagagttcctttaattgaaaaaagtattcgtacagcacgtgatgctatcaaagaagatagcaaataaaaccggttatatatgaaaaatttaaagtattttgcacaaaaatatgtggattgggttattcgcttgggaagaattagattttccctattaggtgtttgtattttggcagtagttgctttgcttacacaaatagtggtgagtttaatttttataggaactatctattggcaagatgtagctcgttctattatctttggtttgttttcagctccttttgttttatatttttttacgttattggtagagaaattggaaaaatcacgccttgatttagcgaagttagtggataatttacgcaatgaggtatcagagcgtattcttgctgaaagaaagttatcggttgcgttgagtgagattgaaaaaaccagtcaagataagaccgcacttatgacaacaatcagtcatgaattgcgtacccctttgaatggcattattggcttaagccagattttgcttgatgacaaattaacagagcaacaacgtaattatcttaaaacgattaacgtgagtgctatttctttgacgcatatttttagtgatattattgatctcgaaaaaattgatgccaatcgtatagaattacattatcaaccgactaatttgtgcagctttttaaatgatattaccaattttgctacattaatggcggcacagcgtaaattaaagtttgaattggcgtgcgataaagatttacctgattggctgatgttggatagtgcaagattaagccagatattatggaatttaattaataatgcagtgaaatttacacctgccggaaaaataaaactgaaggtttctcgcttgacggatgatactttttcttttgcgttatctgataccggtgttgggatagcaaaaggggagttggataaaatttttactatgtattatcaagtacaagaaaccgatcataaacctatcggtagtggtatcggtctggctgtgtctaaagcaatagcaggtttaatgggcggtgatttaaccgttgaaagccaattgcatcaaggggcaacctttacgctcactttacaggctaaagctgtagaaaaaccggcagaaagcgaatctaatgtgcctaatacattgacgatcctattagttgaagatattgaggtaaatattattgtagctaaatccgtattggagaaattaggttactgtgtggacgttgccatgaccggtaaagaggctattcaaaaatttgagcaaaattattatgatttggtgttgttggatattcaattgcctgatatgtcaggatttactattgcacaatatttacgtgaaaaatatgaacaaggtgtttatgattttctccctcctttaattgcattgaccgctaatattatgcaaagtaaaaccgaatatcaaaaacaaggcatggatgatgttttacgtaaacctttatctttagaggcgttagtaaattgtttatcggattatttcggtgatgagttaaatacaaagattattaaaaaatcctctttcgtagagttttctgctttatccgatgttcttaatatggaactgttggttgagctgaatgatattttaggtaaagaatttattggtaaaaacctattattatttaagcaaactatgccaagctatgtaaatgaattattagacagttatgaacaatataaacaggatagtgcagtaaaaaaagatttactttctaatgtacataaaatcaagggagcggcggcatccgtcgggttacttcgtttacagcaagttgcctctttggctcaagatgctaaccacgaaaattgggaaacgcatatcgatgagtggatcaataccttggcaaatgattggttggttgatacggcgacattagaggattggttgaatgatctgtaatttattaaggaataatagttgcaaaaaggggagtacaactttaaacttgagcctttgccattgatatagttaacactcgaataattatgacaaatttaactgaaaaactggaagaaactgccagcaataatgagcttttattaggtgagcgttttcgcatggctcgtgaaaaattacagttgtctttagatgatgtatctaaacaaattaatttaagacccgctattttacagcttcttgaaaataatgagtttacacataagagcattcctacaactttcatgaagggttatgtgcgtaattatgcgaagtttctacgcataccggaagaaatatggacaaaagcaatttcctccgtggaggaaaatacacgccataatttaggtaaaaatacttgcttgatgaaagcggtaaatgggcattcttctcatgggcgttggattggttatgtaacggtattggtgttgttgattgtatccggtatgacggcgttatggtggtggggaaattaccaaaaatcaaatcaagaacgtgacacttttgtacaacattatgtagaaaatgtaccatcggagcggattgaaattcaagcggatcaagtgcttgaaaaaaatttaacgatccctgtggaaaagccacaggttgtttctgttaatgaaactactgtcgtaaataaagacagtatggcagaaaataagttgacctcagtttctacgcaagagcaaagtgcggtacaaaatccacaagaaatagtgagcaacaaaacatcagaaactgaaaaaacggttaaaaatacagaaacctttgtcggcggtgatttgcaaatagaaattatcggggccagttgctggattagtgttaaagacgctaaacataaagtattagcacaaaaagaatataaacaaggcgaagttttggtctttactgatggatcaccttattctttaattatcggtgccccaagcaatgttaaaattacttacaaaggtgaacattatccattaaaagttgacggacgtgttgctaaattcaaattacagtaaattattatgtcatcgtttaaaccaactattaatcgtcgtcaatcgacaaaaatttatgtgggaaatgtaccgataggtggtgatgcacctattgccgtacaatctatgaccaatacaagaacgactgacatagaagcaacagtggcacaaattaaagcattggagcgtgtcggtgctgatattgtgcgtatttctgtgcctactatggatgcggcagaggcgttcaaatcaattaaacagcaggttaatattccgttagttgcagacatccactttgattatcgtattgctcttaaggtggcggaatatggggtagattgtttgcgaattaatcccggtaatattgggcgtgaagatcgtatccgtgccgttgttgattgtgcgaaggacaaaaatatccctattcgtataggtgttaatgcaggatctttagaaaaagatctacaggaaaaatatggcgaacctacaccggaggctttgctggaaagtgcgttacgtcatgtggaaattttagatcgtttgaacttcgatcagtttaaggttagtgtgaaagcctcggatgtctttcttgcggtagaaagctatcgcttattggcaaaagcaattaaacaaccactgcatttaggaattaccgaagccggtggagcacgtgccggtgcggtaaaaagtgcggtcggtttggggatgcttttagcggaaggcattggcgatacattacgcgtttctttagcagccgatcctgtcgaagaaatcaaagtcggttttgatattttaaaatctctacgtattcgttctcacggcattaattttattgcctgtccgacttgctctcgtcaggagtttgatgtgattggcaccgtcaatgcacttgagcaacgtttggaagatattgttacaccaatggatgtatccattatcggttgtgtggtgaacggaccaggcgaagcgttaatttcagatcttggagtaacaggcggtaataaaaagagcggttattatttagatggaaaacgtcaaaaagaacgctttgataatgaggatttaattaatcagttagaggcaaaaattcgtgcgaaagtcgcacagcaagatccaaaaaacagaattatctaaaggaagaatattgtggcaaaaacaattcaagcaattcgaggtatgaacgattgttcacctactgaaagtctcttgtggcagtgggtagaagaaaaagtgcggtcggttttacaaacttatggttattctgaagttcgaatgcctatcgtagaaagtacccctttatttgctcgtgctattggtgaagtaacagatgttgtatcaaaggaaatgtacacattttgggataacgatgaacaattaactttacgaccagaaggtactgccggatgcgtgcgtgcggcaattgagcatggctggatttacaataatgaacaacgtctttggtatatgggacctatgtttcgtcatgagcgtccgcaaaaaggacgttatcgtcaattccatcaagccggtgtagaagtgtttggtatagcgaatccagaaattgatgctgaattgattttattaactgctcgtttatggaaacaactgggtatttttgatcatgtaacgttacaacttaattctattggttctcttgagtctcgacaaaattaccgttctgcattagtggaatttttacagcaacatacggatctattaagtgaggaagaaaaagaacgtttagtgaaaaatccactacgtattttagatacgaagaatcaggtgctacaagaagtattaaatgatgcaccgaaattattggattatttagatcaagagagtcgagaacattttagtcaactatgcgatttattagatgccgtcggtattcaatatgaaatcaatcctaaattggttcgaggtttagattactacaataaaacggtgtttgaatgggtaacttccgctttgggggcacagggtacagtttgtggcggcggtcgttatgacggtttagtcgaacaacttggcggtcatgcaacttgtagtgtgggttttgctatgggattggaacgcttggttttactggtgcaagaagtgaataagcaaatcgttttaccaagtgcggtagatatttatgtggtttattttggtgaaaaaacgactttacctgcattccagttagctgaaaaaattcgtacggaattaccgcatttacgcacaatgacacattgtggtggcggtaactttaagaaacaatttaaacgtgcggataaagttggtgcaaaatttgctctagtgattggcgaaaccgaggtgaaaacacagcaggttgtcgtaaaagatttactgggtggtgccgagcaattgagcttggcattaacagatgtagttatttacttaaaacaagcaattactcaataaggatactaaaatggcttatacaatcgaagaagaacaagaattgaatgaattaaagacttggtggaaagaaaattacaaatctattattgtaattgtggttcttgccttttcaggcgtatttggttggcgttattggcaagattaccaaacaacgaaaaaacaaacactttctgcacaatatgatcaactgatcagcagtgccgaaaatcaaagcatctacaatgctcagctggatcggtttgtgcaagaaaatggagaaacaacttatgctgtgtttgccttgttagataaagctaaacttgaagtcagtcaacaaaattttgtgcaagcagaggaaacattaaagcaggctattgtgaatacgagtgatgatattttaatgtcaattaccgcaattcggctagccacagttcaatatcagttacaaaagtttgatgaggctttagcaagtcttaatcaagttaaaggtcaatcttgggatgttagcaagttgttattgtccggtgatatacagttggcaaaaggcaataaagagatagcaaaggacaattttgaacaagcactaacaaaagccacatcttgggaaaaatcattcatccaagtcagattaaatagtctgtaattgtctaattattgaagccttgatacctcaaggcttttttataggaagttatttatcatgaatattcaacacttattgaaaacacaagcctatattaatggagaatttatttctgccaaaaatcaccgcacttttcccgtgataaaccctgctaatcaacaggttatttgtgaaattgcctgttgtggtaaagaggaaacagaattagcgattaaaagtgctaaacaagcacaagtacattggaaaaaatataccgcaaaagagcggtcaaaaattttaaagaaatggtttgaattgattatgcaacatcaagaaagtcttgcatatttactaagtttagaacaaggaaaaccgcttagtgaaagtcgagctgaaattgcttatggtgcaagtttcgtcgaatggtttgctgaggaagctaaacgtgcttatggtgagattatcccacaggtgagagaagatcatcgattgcttgtgattaaacagccggtaggggtagttgctgcaataacaccttggaattttccaaatgcaatgatcacacgaaaagccgctccggcactggctgcagggtgtgccattattattaaacctgcaccggaaacgcctttatccgctttagcattggcagcattagccgagcaagcgggtataccgaaaggtatatttaacgttttaccgacagtatatgcagaagaagtcggaagtgttttaactcgaagtactgatgtacgtaaattaacgtttaccggttcgactaaaattggcaaaattttaatgcagcaatgtgctgatacggtgaaaaaaataagtcttgaattagggggaaatgcaccatctttgatttttaatgacgcagatttagatagaaccgtcgattctgttatagcctcaaaattccgcaactcagggcaaacctgtatttgtactaatcgaatttatgtgcagtcggagatttatcgtgcgtttgctgataaattaaaacaaaaagtgcgatcatttatcgtaggagattttcagcaagaagcggtaaatattggaccgttaattaatgaaagtgcggtacgaaaaattgaacgacacattgaggatgcgttaagcaaaggtgcaattttaactttaggtgggcaacgccattctctagggggaactttttttgaaccaactattttagaaaatgtgtcgcaagatatgttagtttgccatgaagaaactttttcccctctggcagcgttgattcctttcgatacggaagaacaagcaattagcatggcaaatgatagcgagttcggtttagctgcgtatgtgtatacacaagatttcagtcgtatttggcgactttcggaagaattggaatgtggattagttggagttaatgaaggcattatttccaatgaagtctctccgtttggtggagttaagcaatcgggcttgggtagagaaggttctcgtcacggactggatgagtttttagaaatgaagtatttgtgtatgaaagtttagtttgcaatgcaacaagtcaattgattatccctgctgaggcggaaagtacgacaacacgtgtattaggatcggcaattacaagttttgaaactgcgagattagacatcggtaaattccttttagttaaggaaaggggctattgccccttatgataattattgacgcacagtatagtcgcctgaacaaacccatttgtaggtggtaagtgcttccaatcccattgggcctcgagcgtgtaatttttgtgtactaaccgccacttctgcccctaaaccgaattgtccaccatcagtaaatcttgtgctagcattaacataaactgcggcagcatccacaagggaaacaaattggtgagcaagtcttggtgatgacgttaaaattgcttctgaatgttgtgtgccgtattcggtaatatgtgcaatggcttgttgaatatctttgacaataacaacatttaaatccaatgaaccccattcttgacgtagctgttgttcttgtacaatagatacttctgcattttgtttttccaatattgaaagtgcggtcggatctgcgtgatattttacatttttgtgtttcaaatgagcgacaagcttaggtaaaaattctgtggcgatactttcttgcactagcagagtttctaaggtgttgcatgtactcggacgttgagttttagcattgtcgattacagccaaggctttatcttgctccgcactttcctccacaaatacatggcaaaccccaacaccgccaataatgaccgggattgtagagttttgtttgcaaaactcatgtaaacccgcaccgccacgaggaataatcatatccacatatttatccaatttaagtaattctaatacgaagtttcgatccggatcggtaatagcttgtaccgcatttttaggtaatccggtttgctccaacgcatcttgaattactgttaccaaaattttattggaataactggtttcttttccgcctcgtaagataacagcattacctgtttttaaacaaagcgttgcaacatcgacggttacatttggacgagcttcataaattacaccaataacacctaaaggcacacgaactcgttctaattttgtaccactttctaaaataccgccatcaatgatttgtccgataggatccggcaatgaaatgatatgacgaacatcgtttgcgatactatttatgcgttccttggtgagtaagaggcgatcgataattgcatcagataatccattttcttttgccagctgaatatccttagcattttctacaagaattttattgctttgtaattccaattgttcagcgataatttgtaaggcggtatttttttgttgttgagaaagttgagccaaaatcgtagcggcttgtttagcattttttcccatttcttttaaattcatacaatatccttattttgtttttttaggtaatttatcatgcgttttgactttttctgcttcttgctcttgataatcaaaaataggcaatccccattcgaaataaatggcgagcaaacgaataatgaagccactaattaacgtaataataatgaccaaattttgattaatctgtaattgttgtaagccaacataaataccggtagctaataatgcaatactggcataaagctctttttggaacactaaaggaatgcggttacagagcgaatctcgtaatacaccaccaaaggctcccgtaacgatagcggctatacaggtaacagtaaaaccatgccccatgtccaaagcaatttgagcaccaataatggaaaatacgatcaatcctagtgcatctaagaccaaaaaaatggtacggaagtagcgtataaagtgtttgatgaaaggagctataaaaacagtgagtatagccgctccggtaacaattaagaaataatgtgggtttttaacccaacccaagggataatgcccgagcaagatatcccgaatcgatcctccaccgatggctgtcattgaagcaataataataaccccaaaaatatccattttttctcgtccggcagctaatgctccggttatcgcttctgctgtaatgccgataatgtagagaatactcagtaacataagtgtccttaaagtgcggtaaaaggattactattttagagtgcatagaacaaagaaacaatgttatttttgagctaacccaagaggttaggcggatttattgcaaggaatatttaaccggataaaaaagaaattctcatatcatcaaatttagcaaggattattcattagaagaataaagtatttctttataatgtttacggcataccgacatataactatcatttccgccaatttgaatttgctcaccgtctttgactgctttaccttgttcatttaagcgtaaaacaaaattagctttacgaccgcagtaacaaatagttttcaattcttcaagttgatctgcccaagccaacagatatttgcttccttcgaataattctgcttggaaatctgtacgcagaccatagcataataccggaatattgagttcatctaccacattgcttagttgatagacttgtgctttcgttaaaaactgagcttcatcaattaaaatacaatgtaatttttgctgcttaatatgcagtgctatttcagtaaaaagatcagtgtctttatgaaataaattcgcttgtctatgaatgccaatacgtgaactcactttacctttaccaaaacgatcgtcgatggcagctgtataaactaacgtattcatgttacgttcacgatagttataatccgattgtaataaagttgtagatttccccgcattcattgtggaataataaaaatatagttttgccattatgttaatacccaaccgccggaaataatatatattaagtttgatttttccattatttatcttaaattgctttcagttcagtcattgcccagcggggtttaacgtcaatttccaaaggtgaatattcaccttgttttagacgcaaaaaaccgacgtaagcaatcattgcaccgttatctgtacaaaattgaggttgagggtaaaagacctctccttttaattgtttcatcatatccgctaaagattgacgtaattgtttatttgcactcacaccgcctgcaatgactaagcgtttaaagcctgtttcttttaaagctcgacgacatttaattgctaacgtatctactactgcttgttggaatgcgtaggcgatatctgctttagtttgttcagtgagttcaccttcttgtttaattgcttgattaattgtattggcggcaaaagtttttaaccctgaaaaactaaaatctaagccggggcgatctgtcataggacgaggaaagaaaaaacgttcgggattccctttttctgccaaacgtgaaagtgcactccctccagggtaatccaatcctaataattttgccgttttatcaaatgcttcaccggcagcatcgtcaatactttctcccagtaattcatattgccctacagcattaacacgaacaagctgtgtatgtccgccggatactaataacgctacaaaaggaaattttgggggattattttctaacataggggcaagtaaatgcccttccatatgatgtacaccaatagctttaatgttccaagcataggcaagcgagcgtgcaattgttgaacctactaaaagtgcacccaccaatcccggtccacaagtgtaagctatgccatcaatgtcttttgcttctaatcccgcttgttgtaaagccgcctgaattaatggtgcggttttacggatatgatcacgagacgctaattcagggacaacaccgccataatcagcatgtaaagcaatttgagtatacagttgattggcaatcaatccttttttttcatcgtaaatggcaacgcctgtttcatcacaagatgtttctatgcctagaatacgcattttgtttctcttctttattgaatttcgaaatagagtagattctaccttttttacttaaattaaactagcgtattgatttttttaagagaaaaagtgcggtatttaaaagtgcggtattttttagaatttttttattttttcgacatatctcgcaaaattagcttgcttattttctaaatgaatttttttgtattaacctcttaccagttatgagtacggaacaataggaaaaatatggataaacggaatgagctgttactgcgtttgttacaagtgccgaagttgggagcgtccggaataactcaacttttatcacacatcgatttaaaaacattagaggattatgatgatgttgcgtttcattatttaggctggaaacctgaacagataaatagatggttgtatccggatcttagatatattgaacctgcattattttgggcaagcaaaaagggacattatttgatgaatttctatcaagagaattacccttatttattaaagcaaaccataggtgctccccctttgttatttatcaaaggcaatccggaaatacttgctcaacaacaagtcgctattgtaggaagccgtcattgctcacattatggcgagtattgggcaaagtattttgcaacggaattgttccttgccggttttgttattaccagtggactggctctagggatagacggtttttgtcatcaggctgttgtggatattcaaggacaaactatcggggtattagggggaggtttggaagagttgtatcccaaacaacataaaaaattagcacaacaaatgctagattatggcggtgcgttagtgtcagaatttttacctcatcagcctcccaaaccacaacattttcctcaacgtaatcgcattattagcggactttctaaaggtgttttagtggttgaggcaacagaaaaaagcggttcactcattactgcacgttatgctttagaacaaaatagagaagtttttgcacttccaggacaaattcaaaatgagtatagtcaagggtgtcatagattaataaaagacggtgcgttgttagtagagaatgttgcagatattgtagaaaatttatcgccttttacgcattatgaacgtcaactaacagcaaaacagatagaaacgcaatttccgccggcttataagttacctgcttcaccgacttatcctgaactctatgcccatattggttatacgccggtagggcttgatgaattatcaaataaaagcggattaagtgtagataccttattgatacagctgttagaacttgaattgcaagatctcgttattgctgaaaaagggttatatcgacggacttaaatgttgatataagcgataactgacttgttttgtgtttttttcttttaataattgccaatttgcaggcgttgttaaggttttttctcgttccgtttccacataaataagtgcattggcatgtaaccaattatgctgtactagtaacttaatggcttgttcagcaagattaaagtagaaaggaggatcaataaaaacaatatcaaagtgcggttcggtttgagttttgtttaaatagtgcaaactgttttgattaataacgtttgcattggtacattttaatatagcgacatttttattgagctgattagctattgttttgtctaattcaaggaatgtaacattttttgcttggcgtgaaagtgcttcaaagccgagagaaccgcttccggcaaagcagtctaaacaattggaatcaacgatatgaggcattagccaattgaataaggtttccttaacacgatctcctgttggtcttaaacctgtagaattcaaaacaggtaattttctggcacgccaaagtccggcaataattctgacttcccctttgtttttctcttgtatacggtttggttgattttttttcattaaaaattaattatgataaactaaatgcagtttcgtaattttaacagaaaagtgagcaattttatgtcagaagaaaagaaaaaaggtagattttggtcttggttaggattggggcagaaaacagaagatccgatatcagaacagcaaccggagcaacaatcaggacaacaggaaagtgttgcaagcgagcaagaatctacttcgaatatagagcaggttataaaagaaccagagcatattgatgacacttcatcagacttggttttatccgctcatttacaggagcaagaggtaaaagaatactcacttcatgaacgggaactgtctcaaaatactgtaatagaaatagaaagtgcggttgaaaaaacagatatttttattgaagaggatacaacatatcaggctatcaataaggagcagcgagaggaaacaacgattacatcggttaaagaagtaataccgcaagaacaagaaaaaccggctgaaaatggtttttttagtcgtttagtcaaaggattattaaaaaccaagcaaaatatcggtatcggtttccgcagtttgtttttgggcaagaaaattgatgacgagttatttgaggagttagaagaacaactattgatcgctgatatcggtgtgccaactacgacaaaaatcatcaataatttaattcagcatgcaagccgtaaacaattgcaagaggcagatttactttatcaacaacttaaagtggaattagccgatattttaaaaccggtcgagcaacctttacaacttgataacagtaaaaaaccttatgttatcttgatggttggtgtaaatggtgtgggtaaaaccactacaatcggcaaattggctaatcaattccaaaggcaaggcaaatccgttatgttggcggcaggagatacgttccgtgctgcggctgttgagcagcttcaagtttggggagaacgtaaccagattcctgttattgcacaaagtacaggttcagattctgcttctgtcatttttgatgctatgcaatcggcagtggcacgtaatattgatgtgcttattgcggatacggctgggcgtttgcagaataaaaataacctgatggatgagttgaaaaaaattgttcgtgtgataaaaaaatgtgataaaacagcaccgcatgaaatcatgctaactcttgatagtgggacgggacaaaatgcaattagtcaagcgaaattgttcaatgaagcggtaggattaacgggtattagtctaaccaagttggatggaacagcaaaaggcggtgttatttttgcgattgcagatcaatttaatttacctattcgctatattggtgtcggtgagaaaatcgatgatttacgcccattccaagcagatgaatttattgacgcactttttgtacaagaagagtaaatgttgaaatacagatcttagaatgattatcttagatggcaagttattatttagcataaaacgtaggaaattctatactatcgttgactatgcctctaatgataggaagtgcggtattttttatatgaattcaatctagttttaaatcattttacttaacattacttagaaataagatgatgttttcggatgcccaacaatattaacatcacaaaataagttatcacagcgacgaaaatcagccagcccagccaatgtacacgagtgaaaaaggtcatttgtttccagagactgagtgctggtgaataataccaaataaccattcccataatgatcgcagagattaaaactttgacaaaaaagaccgcactttgtcgagtaaaatggtaaatatccgctttagctaatcctcgataaagcaagtaagcattcagtgttgctgacattgctgaagcgatagccaatccaatataactgaacgggatagcgagtaaattaaatcccatattacttaccatagcaataattccaatttttaccggagtttgggtatcttgccgagcataatagccattggctaaaattttaatcagcataaaactcaacaatccggcgttaaatgcccaaagggaataagaggcggcttgcacatcagaaaatgaaaatttcccacgcatgaacagtaccaataacatcggttgtgccaaaacagcaataccaatcattgccggaatgccaaataataagatcattctgacgccccaatccattgtttgacgaaaatcaaccgcacttttttcaatgttatctgtacgattaacataatgtcgagatagagttggaagaataaccgttgaaatcgcaataccaaataaaccgagaggaaattctaataagcgatctgagtaataaagccagctgattgatccggtcattaaaaaactggcaataaaagtatccaatagaagatttatttgatttacagaaacaccgaatagtgccggaatcatcaaggctcttattttttttacgccctcatcatgccaagcccattgaggttttgttaaaaatccggcttgttttaaaaaaggaatttgaaagagaaattgtagcaagccgccaataaagatcccgatagcaagagcaagatcaggactttctaatcgaggagcgagaaaaagagcggtgcaaatcatagctatattgagaagaacgggcgaaaaagacatcacgccaaatttaccgatggtatttaaaattgcaccggataacgccacaaaagtgataaaccataaataagggaaagtaattttgaggagtaaagaggcttgttcaaattttattgcattggggctgtcatttagccaatcaataaaccaacctgtgccaaagatcgccgtaattacaggagaaaaaagcattgctaataaggtcactactgaaaccaatccgcccaaagtacctgatactttacctataaattctctggttttacttaaatcgcctgatttttggtattctgctaaaactggtacaaaggcttgtgaaaaagcaccttcggcaaataaacgtcttaaaaaatttggaatgcgattagcaaataaaaaaacatccgccactacacctgcacctaatatttgtgcagtaataacatcacgaattaaacctaagatacgtgataacaaagtcattgcactgacgataatgcctgatttcaataattttttgctcaaaataagtttcctttcatgaaaaattggcttaattgtatataaattttgtttttaagctatattccaaacgaaaaaactgttagaattccgcctacatcgtaactaggctcaacaactaaaggcaattgaggaaagctaacgatggttgtttcggttgtgtctcaccgaaatcctcaacccaaattttgctaattgtttattgacaattgtatagaaaaaaggcatattttacgcctttattttttcgtaaactaacagatattttaggagtttgaccttggctaatatcaagtcagctaaaaaacgtgcggttcaatctgaaaaacgccgtcaacataacgcaagccaacgctctatgatgcgtacttttatcaaaaaaacctatgcagcagtagcaacaggtgataaagcagtagctcaagctgcttttgttgaaatgcaaaaagttgtagaccgcatggcatctaaaggcttaattcacgctaacaaagcagctaaccacaaatctaagttagcggcacaaatcaaaaaattagcgtaattttttaaaaccgataaaaacaaaaccgcactttaaagtgcggttttttatcagctgttgattaacgggtactggtactcgttgtcgtacggtttgcacgtttacgctctacctcagttaaaagttttttacgaatacgtacagaaattggcgttacttcaactaactcatcatcatcaataaactctaatgcttgttcaagtgtgagtttcaatggtgtggttaaagtcaaagcatcatctttacctgaagcacgcatattggtgagttttttaccctccagcggattgacagttaaatcattagagcgactatgaataccaattatttgtccttcataaatttctgcaccatgatcaaccattagcttgccacgatcttgtagggcataaagtgaataagccaaggctttacctgtaccgtttgaaatcagtacgccgttaatacgctggccaatttcacccggttttacatcatcataatggctgaaacttgagtaaagtaagcctgtccctgaagtcattgtcataaattcattacggaaaccaatgagaccacgacttggaataatgtattctaagcgagtacgacctttaccgtccggtatcatatcacgtacttcacctttgcgaataccgagtgcttccatgacagaaccttgatgttgttcttcaatatcaatagtcacttgctcgaaaggctcttgcttgcgaccatcaatttctttaaaaattactttaggacgagaaaccgccagctcatagccttcacgacgcatattttcaattaatacggataagtgcaattccccacggccggatacactgaaaatatccgaatcatccgtttcttctacacgcaatgctacattatgtacaagctcttttttcaaacgctctaaaatttggcgggaagtgacaaatttaccttcttttccacagaatggtgaagtatttacacaaaagaacatagttactgtcggttcatcaacgcttaatgcaggcaatgcttccacattgttaatatcacaaacagtatctgaaatatttaactcacctaaaccggtaatggctataatatcacctgcataagcttcttgagcttcgtaacgctgtaaacctaagtgtcctaaaacctgaccgatacgaccattgcgggttttcccttcaggatcaattaatgtaacaggttgatttggttttactgtaccacgtttaatacgtccaatcccaatgacacctaaatatttgctgtaatctaattgggagatttgcatttggaacggtgcatccaactcaacatccggcggtgaaacatgttcaataattgcttcaaagagcggatccatattagaagccaatttttcatgttcaagaccggctacaccgtttaacgcagaagcataaataataggaaaatcaagttgttcatctgtggcacccaaatttacaaagagatcaaatacttgatctactacccagtcaggacgtgctccgggacgatccactttattgattacaacaatcggttttaaaccatgtgagaaggctttttgggtgacgaagcgggtttgtggcattggaccatcaaaggcatcgacaaccaacaatacggaatctaccattgaaagtactcgctctacttctccaccgaagtctgcgtgtcctggtgtatccacgatattaatacgatagccgttccaattaattgcggtatttttcgcaagaatagtaattccacgttctttttccaagtcattggaatccattacacgttcatcagtatcaccacgagaagtgtctaatgtgcctgaaagtttaagaagcttgtcaacgagggttgttttaccatggtcaacgtgtgcaataattgcaatattgcgtaatttttgaatatcaattttatctgtcatttgaataatctagagttataaaaaattaaaaatttcttccgcactttacgtttcaaaatagttcatttttacatctataccgtgcggaaaggtcgccgattatacaactttttgttattaggagctataaaaaaacgacctccgaccttcaccgatataaaattccctatcctattcccctctaattgattataatctccgttcaaatttatttccgttcccactaaagtagagagagtattatgtcaaacacaacagctattacaaatgtattcaagttaatcgaagaaaataatattaagtttgttcttcttcgttttaccgatatcaaaggtaaagaacatggggtttccctgccggtcagtttagttgatgaggacttgtttgaagacggtaaaatgtttgatggctcctcagttgaaggttggaaagccataaataaggcagatatgttattgatgccaattgctgaaaccgccgttgttgatccttttgctcaaattccgacactttcaatccgttgcagtatttttgaaccgactaccatgcaaagttatgacagagatccacgctcaattgccatgcgtgcagaaaattatatgcgttcaacaggcgttgcggatgatgtattttttggccctgaaccagagtttttcttatttgatgatgtgcgttttgatgtctcgatgaacagtaactcttatactgtcgacgatattgaggcagcatggaatacaaataaacactatgaaggtggaaataaagcctatcgtcctttgaagaaagggggatattgtgcagttgcaccgaatgatatcgcacatgatattcgctcggaaatgtgtttgttaatggaagaaatgggattagtgattgaagcccatcaccacgaagttgcaacagcggggcaaaatgaaattgccactaaatttaatacacttacgttaaaagcagacgaaacgcaaatttataaatatattgtgcaaaatgttgcgtatgaacatggcaagacagcttgctttatgccaaagccgattataaacgacaacggttcaggtatgcattgcaacatgtctttgagtaaggacgggaaaaatattttccaaggtgataaatatgcaggtctttctgagaccgcactttatttcattggggggattattaagcatgccaaagccttaaatgcgtttaccaacccatcaaccaactcttataaacgcttagttccggggtttgaagcacctgttttattggcttattcagcaagtaaccgctctgcatcaattcgtattccggcggttactaatcctaaggctattcgtattgaagcacgtttccccgatccgttggctaacccatacttagcgttttcagcattattaatggctggtttagacggtattcaaaacaaactttaccctggtgatgcaatggacaaaaacctctatgatttaccgccggaagaactgaaagacattcctgccgttgcaagttcattaagtgaagcgttagataatttagaaaaagattatgaattcttaacgcatggtaaagtgttcagcaaagaatttattgatacgtttattgcaatgaaacgtaaagaagtggaacgtttaaatatgacaccacatccagtagaatttgaaatgtactacgcttaatactggttagataaacaaaaagcgactaaatttgtttgatctgacctcacaggctagacagatttaattcaaggactgtgttatatcatttacaggtcgcagtccttttagtttcacgtgaatatattcaaattgttgtaataaagtatctgaaattttcccgactttactctgataagaggatattttcttcgctggcaattcttaattttataccgcactttttactctttttttctcagcgaaacttctcctccgttaaattttctcaacactccattattcaacgctactaatagataaccctcttcatcaataccttgctcaattccacaaacgatttctttttcgctaataatatttacttcttgtccaaaaaaataatccaacttaatccaacgctgaaaaaaagcatgcattccctgttgctcaaaaatagtcaaatattgataccatttttttactaattgaattgcaagatcattacgatctatttccggcaaagtttccaataattccgcccaaggttgatcaattttgttttcttgcggtaaagataaatttatcccaatgccaacgataaaattaagtaatccatttttagcattgacgatttcaactaaaattcctgctaatttccgtccgaacaatagcagatcattcggccattttaacttaacccccgcacccatttcatttagcacttcagcagttgccagtcctaatactgaacttaaaccgtttaacgaaactgtcggattgaatgtccaataaaaactcaccattagttgaccggcaaaaggcgattgccattcccgtcctcgtctacctcgccctgcaaattgatactcggtaaaacacaagtctccttttttcaactgtaaaatgttttccatgagatactgattagttgaattgataatagggtgataataaatcttatagggactcaattttgttgccaaataagagagatttaataaaggaagttgcggttttaaagaaatattttgctcatcaataacaataaaaattccctgttgccttaattgtgctatccgctcttccagctgttcttttgtcaggtctaaaagtgcggtcaaattttcataagaataaggtttgcatctagctagaatagacaataatttaaacattttttcctcatcgtcaccattataaaatctctattaaacgtatttttaacacaatctttttcaagaaaaaatattataaaaaagcattttcaaacaagtatgagatctgtataatcccgacgcaatattttttatcctttttaatcttaatagagagaatattgcactatgttacgcatcaaacaagaagctttaacttttgacgacgttctattagttccggctcattctacagtacttccaaatactgccaatctttcaactcacctgaccaaagaaatccgtctaaatattcccatgttatccgccgcaatggataccgttaccgaggctaaattggctatttctttagctcaagagggcggtatcggatttattcataaaaatatgaccattgaacgtcaagcagatcgtgtgcgtaaagtaaaaaaattcgaaagtggaattgtatctgaaccggttaccgtttcaccaacaatgacgttaactgaattagcggaattggctaagaaaaacgggtttgcaggttatcctgtagttgatgaacaaaaagggttggtagggatcattacagggcgtgatacacgtttcgtttcagacttgaataaaactgttgcggattttatgaccccaaaagatcgtttagttactgtgaaagaaggggctactcgagaagaaattttccatttaatgcacgaacatcgtgttgaaaaagtgctggtagtggataacagctttaaactaaaaggaatgattaccttaaaagactaccaaaaggccgaaagtaagccgaatgcgtgtaaagatgaatttggtcgtttacgtgttggtgccgcagtcggtgccggtcccggtaatgaagaacgtattgaagccttagtaaatgccggtgtggacattttattgattgattcatcacacggacattccgaaggcgtgttgcaacgggtacgtgaaactcgtgctaaatatccaaatttacctattattgcagggaatattgcaacagcggaaggtgcgattgcattagctgatgcgggggcaagtgcggttaaagttgggattggaccgggatcaatttgtacgactcgtattgtaacaggtgtgggggtgccacaaattacggcgattgctgatgctgctgaagcattgcgtgagcgtggtattccagtgattgccgatggtggtatccgctattcgggtgacatcgctaaagcgattgcagcaggtgcatcttgtgttatggtcggatcaatgtttgcaggaacggaagaagcaccgggtgaaatcgaactttatcaagggcgagcatttaaatcttaccgaggtatgggttcccttggtgcaatgtcaaaaggatcttccgatcgttattttcaatccgataatgctgcggataagctagtgcctgaagggattgaagggcgtattccatacaaaggcttattaaaagaaattatccaccaacaaatgggtggattacgttcttgcatgggcttaaccggctgtgcgactatcgaagaattacgcactaaagcccaatttgtacgtatcagcggagcaggcatcaaagagagtcacgttcacgatgtgaccattaccaaagaagcaccgaattatcgaatgggctgatataacaaacggttggtttttgcaaaatttgcagaatttgtgtcgcttgtactgagataaggagcataaaatgaaaaaattaggtttgatttctatactgttattgtccggctgtggcatttttggtccatcatattcagggcaaacaacagcagactggttattaaaatcagatacagaaagcactattaggctatattttcgtgctataaataattgtggaatagaaaaaatccatacggaaatcaattcaataccgagtgcaggtaatgtaaatgaaacttggactgtaacaggctgtaatataacaaacgtttttaatgtgaaatatgttagtgacggtcatggcgggacttactttcgcgtatctaaaaaataaactaaaactttaggaaacaaaatgacaaatatccatcaccataaaatcctcattttagatttcggttcacaatatacgcaacttatcgcacgtcgtgtacgtgaaatcggggtgtattgcgagctatgggcttgggatgtaacggaagcacagatccgtgaatttaacccaacagggattattctttctggcggaccggaaagtacgactgaagcgaatagtccacgtgcaactgaatacgttttcaatgcaggtgtacccgttttaggtatttgctacggcatgcaaaccatggcaatgcagttgggcggtttaacagaaacttctacgcatcgtgagtttggctatgctgaagtttctctacgaaatccaaccgcactttttgatcatctcaatgatgatgcgaccacttctcagactacacttgatgtttggatgagccacggcgataaagtgactcgcctacctgataatttccaaattacaggcatgacctcgacttgcccgatcgcggctatgtcagatgaaagccgtcgtttctatggcgtgcaattccaccccgaagttacccacacaaagtgcggtcaaaaattactgcaaaattttgtggtagatatttgcggttgcgaaaccaattggaccgcagaaaatatcatcgaagatgcagtggctcgcattaaagcacaagtgggcgatgatgaagtaattttaggcttgtcaggtggcgtggattcatctgttaccgcacttttattgcatcgtgccatcggtaaaaatttacattgtgtctttgtcgataacggcttactccgtctaaatgaaggcgatcaggtcatggaaatgttcggtgataaattcggcttgaatattattcgagtagaagcagaagatcgctttttagaagcattaaaaggaattgatgaaccggaagcaaaacgcaaaactatcggtaaagtattcgttgatgtattcgatgatgaagcaaaaaaattaactgacgtaaaatggttagctcaaggtacgatttaccctgatgttatcgaatcggcagcaagcaaaaccggaaaagcccacgttatcaaatctcaccacaatgtaggaggcttacccgattatatgaaattaggtttagttgagccattacgtgaactcttcaaagatgaagtgcgtaaaatcggcttggcactcggcttgcctgcagaaatgcttaatcgccacccattcccaggccctggattaggtgtacgtgtactgggtgaaatcaaaaaagaatattgcgatttactgcgtaaagccgatgcaatttttatcgaagaactgcataaagcagattggtactacaaagtcagccaagcgttcagtgtcttcttgccggtaaaatctgtcggggtaatgggcgacggtcgtaaatatgattgggttattagcctaagagcggtcgaaaccattgactttatgaccgcacattgggcaaacctaccttatgatttattaggtaaaatctcaaatcgcattatcaacgaagtcaacggcatctcccgtgtagtttatgatatctcaggcaaaccaccggcaacgattgagtgggagtagttaaaaatctaaagccttataaatrgmyrttttktragtgkygtgcttgcaataaatcacctgaaggataattcttcgggtgattatactattaattcagggactgtattagattagccctaaatgacacacattttcgtagtgtttttaactgctctttagatattccaaagacttacattccttcaaaaataaaggagagtttattcggtcaattccattgtattttcagagtattcgtttggcttagcccccaaattttctatgtcgttgatgtagtcttgtttgactgcccccgaaatgattaattctttcgtggtgaaattcacttacatcaagggctaaatgataacggattagctcatggatgtttcgataaaacaaggcacttgaatttggattgatacctaaaatattagctgctgatcgagctgtcacttctaacacaaaaaattcaaggagctttttctatatagatttctttaatttacaatgagttgtcttcatttttatagactagcatacttgctaatctaatattgcccctttttttatattgatgagtttgatagataggcactatcctaaaaaatcacaaaggcagcttgattctacaggtgataagattggaaatcggaagcttggtagagaagcaatttaaaagatatattaatatcataattgcccgaattttcgctaaaaacgtaatatcgggcaaattatatggcattgtaaagagaataaatgtgaagcagttcacattctatacacaaattattgctgtatgatgaaataatttgttttattttatatgagaattgaaaatatatttcaaacttgtttcgtaatatataaagaggagtttgttatatgaatagtaaatttaccccccccctctccatttccacgcctgttgggaatctattaaacagcatcaagttcctgaatggtatgaagatgctaaattcgggatttttattcactggggaatttattccgtccccgcgtttgcaccaccgacttgtcaattaggcgagatcgatattgacgagcaatggttctgtaacaatccatatgccgagtggtatttcaattcaattaacgtcaaaaaaggtccgacttacgagcatcatatcaaaacctatggtgaagatttcagttatgaacagtttattccacaatggaaagcggagaagtggcaacctgccgaatgggcggagctgtttgccaaagcaggtgcaaaatatgtggttctgacgactaaacaccacgacggtttttgcttatatccgagtaaatataccgatttcaactgcactgaagttggtccacaacgtgatttgatgggcgagctgactgataatgtgcgtgaaaaagggctgaaaatgggagcttactactctggtattatagactggacctactcttctgcaccgattttcaccgagagtcaaaacttttccaatgcttgcccaacctatgaatacgccgattacgcttataaacaagtggttgagctgattgataaatataaacctgatgtactttggaatgacatcggctggccgaaagccggtgaacatatgcttccgcacttgtttgcacactactacaacagcgtgccacacggtgtggttgatgaccgttggaacaagctctggtgcgatttcacctcaaaagagtacaaacacggcgtggcttcgcgtgataaaaaatgggaaatgtgccgtggtatgggcttatcatttggttacaacaaagtggaagatgaaagccacttgatttcagtgaaagatctgatttcgctcttagtagaaaccgtggcagacaacggtaacctgttgctcaacatcggcccaaaagcagacggtactattccacaagagcaagttgaacgcctactcgctttgggtaaatggttggagcaaaacggtgaagggatttatcgctcccgttgcagtaaatattcccccgaaactgtaaacggtgtaacaatgattgcccgccctcagatcgaccaaaatcgcacgtcttaatcgttccgagtgctgtatcgttacaacaaacagcggctgtttaaggaatccatcagcagcgtgggcgtgttaaaaactgtttacattccttaaaaaaatacatataataacaattcttatttgcatattttatataatacaagaaaggatataggtaaatgacctctttcaaattattaggcttttcggtcttgagtgtggctttgctctctgcctgctcttccggcaaaggtggctttgatttagacgacgtcgagcatacccccccctcctcctcaggtagttcccgccctacttatcaagatgttccgaccgaacaacggcagcaagaaacagtagaagaaatcaaccaacccgccctaggttatgccacagaaattccgcgtaggaatatttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaacacgctacaaaattgatgctgatatcaaaggcaaccgttttgttggctctgcaacggcaacagaaagtggtcacactatctttggtaaaaactctcctaagaatctcgagggcggtttctttggtcctaaagccgaggaactggcaggtaaattcttgaccgatgataattccctgtttgtcgtctttggtgcaaaacgtgaaagtaaaggcgatgaaaaactagaaacccgctttgatgccgttaaaatcagcacggataggaatgaattaaaaaaagaaacgatggatacgttcggcaatgccgsctatttagtgttggacggcagacagtttcctttggtgccggaaagtaatgccggtacgacgggcgctggcaacacaggcaagaatgatttcatcaccaccatagacggtagcaaattaagcaaaacaaaccatgataagcacaaaaactacaaagttaccgtatgttgcagtaatttggtgtatgtgaaattcggcagctatggggaacaaacaacagcaaacggtgcttcaaacagcactgccggtgcagcaactacgcataacggcacattaacaaacggacaccttttcttaaccggtgaacgtactccgatggcagatatgatgaagcaaagtggtgcaccaaagtatattggcatctggcaagccaactttttaagtagcaacggacaggttggcagtgttgacgccggtgatccgcgtaacgatagtggtaaaagccgtgctgaatttgatgttaattttggtggtaagacagttacaggcaagttttttgatgccaacggtactcaacccgccctcacaatggaaaacgccacgattacaggcaacggcttctccggtacggctaagacaactggtggtttgcaattagataaaggcagtacaactggcggtaccaaagtgaatatcaccgatgctaaagtcgatggcgcattctacggtcccaatgcaaatgaaatcggcggtaccatcacatcgaatggcgcaggcgataaagtcggcggggtgttcggcgcgaaacgccaagaaccatcgaaatagaaatgaaatcttaactctagctacctgaaacacatgtcaggtagcaggatgggtatctgctgatatggtcaacctgcttgaaaaagtttgtcaaatccgtcgcctgtcgttgttgacggtgtgatgttgcagtggcaaatcgctcggctctgttgagaaagcatgacccatccgtcttttactcacacggaatgaaaaaaatgtctacaaaacctttgtttaaacttaagccaataacattggctatcagcacgatttttttaccttttactgaggcggttgccgatactgaatcaccgagtagcaatacagaagcagtgctggagttagaagctatccaggtgcaagccaaacacgagatcagcagacatgacaatgaagtcaccggtttgggtaaggtggtcaaaagcagtgaagacattgataaagaactgattttgaatattcgcgatttgatccgttatgatcccggtatttcggtggtggagcagggacgtggtgcaacgtcaggctatgcaatgcgtggtgttgacagaaaccgcgtggctatgttggtggacggcttgggacaggcgcagtcgtattctaccttgaaatccgatgccaacggcggggcgattaatgaaattgaatatgagaatattaagtcaattgaattgagcaaggggtccagttcggcagaatacggtagcggtgctttgggcggtgcggtagggtttcgtaccaaagaagctgatgatgtgattaaagaggggcaaaactggggcttggacagtaaaacggcttacagcagcaaaaacagccagtttatccaatccgttgccggtgcgttccgtgtcggcggttttgacagtttggcgatttttactcatcgtaaaggtaaggaaacccgcgtgcatcctgccgccgaagaaatacaacatacttaccaaccattggaagggtattttaatcggtatgaggttgaccaaagcaacggaacgcctgttcgggcgaatgcgtattatatacttgccgatgaatgttctaatttaagtgatccgagttgtcgtcatgccaaggccaagacgaatagggtgggtgccccggagaacaatcctaattggacgcccgaagagcaggcacaggctgctaaaatgccgtatccgacacgtaccgcctctgccaaagattatacgggtcctgaccgcatcagccctaatccgatggactaccaaagtcactctttcttctggaaaggtggttaccgcttgtcgcctaaccattatgtcggcggggtgttggaacatacgaagcagcgttacgatatccgtgatatgacgcaacgggcgtattacacgaaagaggatatctgccacagcggatccagttgccaaacgttggataaaaatgagacggacaaaggtaatttcggtatcacgttgactgataatcctttggacggtttggtatatgatgccggcaatcaagcgcgtggcgtgcggtacggacggggtaagttttttgatgaacgccatacgaaaaatcgctcgggtattttttaccgctatgagaatcccgataaaaattcttgggcagatagcttgaccttgagtattgaccgccaagatctcaaactgtcgagccgtatccattggacgtattgcaccgattatcctcatgtggcacgttgccgtgccagcttggacaaaccttggtctaattaccgtaccgagaaaaacgattatcaagaaattcttaatctgggacaattcaattgggaaaaaacttttaatctgggctttaccacgcataaggtgaatatcgccgccggctttggtacacatcgctccaccttacaacatggcgacttatatgctgaatatgtcaccttgccgccgtatgaggaaataaaagcgtatgatgataaaggtgcctttaaaacagatacgacccctgaggataaattacaattcggcaatggttcttataacaaacctcgcgtatatagacgtaaaaacacgccggaattaaaaactgtcgatgggtgtaatgcgacagcgggcgataaccgcgactgctcgccacgtgtgattacgggcagacagtattaccttgccttgcgtaaccatattgcctttggtgaatgggcagacttggggttgggcgtgcggtacgacaaccataccttccgctcgaatgacccgtggaccaaaggtggcaactaccacaactggtcgtggaatgcgggcgtgagcctcaaaccgacccgccactttgtcgtgtcttaccgtgtgtccagcggtttccgtgtccccgctttttatgagctgtacggcgtgcgtacgggggcttctggtaaagacaatccactcacacaaaaagagttcttgagccgtaaaccgttgaaaagcgaaaaagcctttaaccaagaaattggtttggccgttcagggagattttggtgtgatagagaccagtttcttccaaaacaactataaaaacctgcttgcccgtgcagataaacatgtcgagggattgggttatgtaaccgatttttacaacacccaagatgtcaaactcaacggtatcaatatcttgggtagaatctactgggcaggcatcagcgataggctgcctgaaggcttgtattccacacttgcttacaaccgtatcaatatcaaagcacgcaaattgcacgacaattttaccaatgtgtctgagccgacattggaagccgtgcaaccgggacgtattattgcaagtatcggctatgatgaccctgagggcagatggggccttaatttaagcggcacctactctcaagccaaacaacgtgacgaagtggtcggcgaaaaagtgttcggcaagggtggcagcattaaacggacgatcaacagcaaacgcactcgcgcttggtatatttatgatttgacggcatactacacttggaaagaaaaattcacgttgagagccggtatctataatttaaccaatcgtaaatatagtacatgggaaagtgtgcgtcagtccgctgccaatgcggtcaatcaagacctaggtacacgttcagcacgttttgccgcaccgggcagaaactttaccgtgagtatggaaatgaagttttaattaaaaaactgtctgcaagctgtttaaaaaacagttgagatgatttgttcgtataaatagctgcttgaagtcttgttatgcaggttcaggcagcttgacattccaaaaaaaggaaaaaagtctaatggaagacaatatgctatttgtcggcaacgaaattaggcaacgaaaaattgttgcaatggattagcagttcaagtggcttccggtattttttatcgcactttttctatctataagcttgaaatctttatttccgaacttatattttcgctgtttgttaatttcactattggaaaaggaaatattatgtcaacaaatcaagaaactcgtggttttcagtctgaagttaaacagcttttacaattgatgattcattctctttattcaaataaagagatttttttgcgtgagttgatttccaatgcgtctgatgcggcggataaattgcgttttaaagccttgtctgcacctgaattatatgaaggagatggtgatttaaaagtgcggatcagttttgacgcagaaaaaggtacgttaaccattagcgataatggtattggtatgacgagagagcaggtgatagatcatttaggcactatcgctaagtccggaacaaaagaatttttggccgcacttggacaggaacaggctaaagatagtcagttgatcggacaattcggtgtcggcttttattcggcatttattgtggcggataaagtaacagtgaaaacgagagcagcaggtgagccgatagatagagcggtgttgtgggaatcagccggtgagggtgaatattctgttgctgatattgagaaaagagaacgtggtacggaaattactttgcacttacgtgaagaggaaaaagagtttgctaatgaatggcgtgtacgtgaaattatcggtaaatattctgatcatattggcttgcctgttgaaattttagcgaaagaatatgatgaagaaggtaaagaaacgggaattaaatgggaaaaaattaataaagctcaagcactttggacaagatcgaaaggtgagatttctgatgaggaatataaagagttttataaacatttaagccatgattttgctgatcctcttttatggacacataataaagttgaaggaaatcaagaatataccagcttgctttatgtgccgtctaaagccccttgggatttattcaatcgtgagcataaacatggtttgaaactttatgtacagcgtgtatttattatggatgatgctgaacaatttatgccgaattatttacgctttatgcgtggcttaattgatagcaatgatttgccgctaaatgtatctcgtgagattttacaagataataaagtgacagctgctttacgtaaagcattgaccaaacgctcattgcaaatgctggaaaaattagccaaagatgacgaggagaaatatttacaattctggaaagaatttggtttggttttgaaagaaggtccatcagaagactttgcgaataaagaaaatattgccaaattattgcgtttcgcttccagtaaaaatgatagctcagaacaaaccgtttctttggaagattatgttgctcgtatgaaagaggggcaaaaggcaatctattacatcactgcagatagttatattgctgctaaaaactcaccgcacttagagctgttcaataagaaagatattgaagtattgttgttgtctgatcgaattgatgaatggatgttaagttatttaactgaatttgacggtaagcaattacaaccgattactaaagcggatttggatttaggcgatttggcggacaaggaacaagaagagcaaaaagagcaggataaaacctttagttcgtttattgaacgagtaaaaaccttgttgggagaacgagtaaaagatgtgcgtttaacgcatcgtttaacggataccccagcagtggtttctactgataatgatcaaatgaccacgcaaatggcaaaattatttgctgcggctggacaacctgttcctgaagtaaaatatacgtttgaacttaatcctgaacatcatttagtgaaaaaagtagcagatttggctgatgaagacgaatttgcaaattggattgaattactgcttgagcaagcaatgcttgctgaacgtggttcattagaaaatcctaccgcatttattaagcgagtaaatagtttgttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaatgttaaaaatattattttcacgtataattcgaagtcgggttttattgactttttattgaaggattgttgatgaaaaaaattatcttctttggaactgttatttggctaactgcttgtaccacaaccaatttatcatcaagttgccagcgttattttagtgtactggaaaaaaatatggcacaattttccctatcaagttctgaactgaccaagtttaaacaaaataaaaataaattaagtcaattgccggaaaaagaacaaaataaaatttgccttttaagaatggcaaatattcaacagtatagaaattgattgtttctgatgtgttcaagtctttttatggaataaatatgacaacgttcgtcgcttggggcaatattcaacaatattatccttttgaaacaatacctttgcggttgctaaataaaaacctaacgcattcagcaagtaactataaacctgtgcagcaacgttatcattgtcgccgtttagcacattttttattgtggcaattgttacaaaaagctggtgttaataccgcacttttaggtgatattaagtgttctccatccaatcgtccttactttttacaagacaatattgattttaatatcagtcattctgatgattgggtagcagttgttttacaagttgatgaaaataatgataaaagtgcagtaggaattgatattgagtttgtcaaaaaaacaagaaattacaccgcacttttacagcattttgccagacggcaagaggtgatttggtttcaacaaaagccttgcgaggcacgtttttatcaaatttggtgcggacgagaggcattgttgaaatcgcagggcgtaggtattgtcaaattatcggaagtcaagcatgaaccggagaaattattacttcactccgattattgcccaacgggaaagctcatatttacggctgagttgcctttttattttgcacttttttgtcatcaacatattgaacaaacacaatattttatgtggcaagataaccggtttgtttcaaaaaaactgacgcaggcaattgaatatcaagtgaatcctttaaagcaattcattcaaatttaaagtcggttttcgttgcataataaaaatgaggtagagtattgctcaaattgaatttacgaagattaaattatcaaaggacaacagagtcatcgtgaaattgcggtagaaattcaggactttttaagtggtaacaaaaagcctcatcaataaaaatgaattgataaggctagaaaatttggtggagataatcgggatcgaaccgacgacctcttgaatgccattcaagcgctctcccaactgagctatatccccgtaaatcgaatgtggcggctatgataaattccgccacttgtgctgtcaatatagaatattaaatattttttttactagattaaatattaaacattttgtgtatgaataaacgcaattgcattatttattctgctaattgtgcgatctttaccaaccaatttcgctgtaatatccattgatggtgattgtcccaaaccagttaccgccaatctaaatggcattcctactttacccataccgatatcaagctcttgggcggtttggctcattacttcatgaatattttcaactgtccagtctgaaagtgcggtgagtttttctgccaatttagctaacggtttaatcgcttcaggcttgaagtttttagcaacagctttttcatcatagttttcaacatcttggtagaaataacgacttgagatggctaactcttttaatgttttgcaacgttcacttaaaacaggaataatttcagctaagttcggaccattgctataatctatgccgtgttttttcatatgccatgctagatgggttgcgacctgctctaccggcagagaacgtatataatgctggtttagccattgtagtttttcagtattgaatgcacttgctgatttgctaaccgaatgaatatcgaaaagtgctatcatttcttctcgactaaaaatttcttgatcaccatgtccccatcctagacgaacaagataattgattagtgcttcaggtaaataaccttcatctcgatattgcataacacttaccgcaccatgacgcttagataatttttgaccatcatcaccgttaatcatagagacatgagcataagttggaattggtgctcccaatgccttaagaatattaatttggcgaggtgtattattgatgtgatcttcaccacggacaacatgcgtaattcccatatcccaatcatcgacaacgacacagaaattataggttggcgaaccgtctgtgcgacggataattaaatcatctaattcacgattgctaatttcaatacgcccacgaacggcatcatcgaaaacaactgtaccttccgtcggatttttaaaacggacaacgtgaggtgcatcaaccgggtattcactttgatgtaagcagtagcgatcatagcgaggtttttgtttattttgctcttgactatgacgtaggtcttccaaacgttctttagtacaataacaacgataagccaatccttgctcaatcatctgatcgattacttggttatagcgttcaaaacgttttgtttgaaaatacggtccatgttcccacgctaaattaagccattccattccctctagaattgccgctgttgcttcaggggttgaacgttctaaatccgtatcttcaatgcgtaatacaaattctcctcgattatgcttggcatacaaccaagaataaagtgcggttcttgcaccgccaacatgtagatagcctgttggacttggtgcaaaacgtgtacgaactttagtattgggatctaaattaaaaagtggttctaatttcattcattttgcctttatttaatcaatcataaaacggtgcttattgtacaatgagttatttaatttcataagaaaaaattaaaattatgtttatttttaagacagttaaatagaaatccataaaaaatcattgactgttttttgataattcttataatgcacctcgcacaatacaagggcgattagctcagttgggagagcacctcccttacaaggagggggtcactggttcgagaccggtatcgcccaccactattctatagtgaactttgtattgtaatattggcttaaggggcgattagctcagttgggagagcacctcccttacaaggagggggtcactggttcgagaccggtatcgcccaccactttagccggatttcccatttgactttaagtcaaatccgatagctgaaaagcgattcgattctatcgggcgattagctcagttgggagagcacctcccttacaaggagggggtcactggttcgagaccggtatcgcccaccaattcaaaaaatctaaatttttccacgttattaaactcattacaactttcggggtgttgtcttttttatttatatttttaactaattattgttcacttttgcgatcttgatcgtaaaactacgatacttgcaaaaaagttttttcctgattccattaaaattattttttatttaacgaataggaaaacatatgcagaatttgaagctattttcttggaaagccactaattttttacagcaaaaacaagctggaatgcttgttatcgaaaatgtacaagaggccaaacgctatttattacaacaagggctaaacaatatatatttacagcgtcattggcaactgaataaaaagcctaaaaaaatagaattttgtgatctattaactcaattagcaatgttattacaatcctcaattcctttaaaagatagcttacaaattttattgagaaattgtgttaatatttctttaaatcaatgggttagatatattttaaaaaatcttgaaggaggattatctttttcacaatctgtggctcaatcaggtctatatttttcttatcaagaacgccaactcatttctgttggagaaatgacgggagatttagcctctgtttgccaacaaatagcagaacatcgtcagcaggcattagcattacaacgcaaaattcaaaaaattttactctatccaatgatagtcttaagtatttctgtcattctcaccgcacttctattaatttttatcgtgccacaatttgccgaaatgtacggttctaatcaatccgagcttcctttttttacgcagctattgttaaacatatcctcttttttacaacagtatttttttcatatgatagcggtatctattttatttttttatctaataaaattacgtttacacaattcatatagttttcaactcaaaaaagattggtttttatcgcatgtgccgttgttaaataaaattattcggcttaatagaacgataagtttttgccgtagtttaggattaatgctcaactcaggcattcctttacaacaaagtctatattctttccttccccaaaactctatcaacatacagaaaaagattgagggagatctcacgttaattaatgaagtaaagctaacattacgtggtatcgaacaaggatataaattctctcagtctgtaagcagtaatttgttttctatacaaacacaacaaatgctacaagttggtgaaaagagtggaaatctaggtttaattctgcaacatatcgcagaaaatcagcaacaacagttagatcatcaaattgatttactttcacaaatgttagaaccgtttatgatggtgatcattggcggattaataggcttgattatgttaggtatgtatttaccaatctttaatatgggaagtttaattcaatgatttatctagcttatatgttgtttggtgggctttgtggcttatgggtttacctttatgtcaggcaattttctgctcagattaataaacaagtttactcgactttttgcgaaattttccccgaaaatgcaccgcacttgatgcctatgtctatcttacgacggaaaaagtgcggtcatttttctatgtattttttgtgtggtggcctttggtgtaatatatgtttaaatttcccacaaaatatttatgttggtttatggttagcatgttgcagttatttaattttttgccttgttttagtggattggctataccaactcgtttcacaaaccttatgccaagccctatttattttagggttattgggtgcttatcaaggtattagcccattgactttggagcagtctttagttggtagcttatcaggcttttcggttttttatcttatttacattgttgcaaaattattctatcgttatgaagctttaggacgtggcgattattggttaatgttagggttagggagctttatatcttggacaaaattaccgttgctcatttttcttgcctgcctcacaggattaatatatgtcgtttttaatgcaagagacaaaaaaacaatatttattccttttgccccgttcttatgtctctcaaccattatcgtatacttgcttaattttctaagggaggatattcttccttaaattttaggggaagaagaatatggcttatattgtagggttaaccggtggtatcggtagcggtaaaagtaccattgcgaatcttttttcagaactaggcgtacctattgtggatgccgatgttgtcgctcgagatgtcgtagcaaaagattccttaatcttagagaaaattattgctcattttggtgaagaagtgcggttggaaaatggtgagttaaaccgatctgaattgcgtaaattggtatttcaaaatgaaaaagaaaaattatggctaaataatttgttgcatccggtaattagagaaaaaatgctgcaacaattacgctctgttaattatccttatgtgctttgggtcgttcctttactcattgagaataagctaatgaaattatgcgatagagtactggtaattgatgtagagcctgaactccagattttacgagcaagccggcgggatagtcattcggttgaattgattaaacaaatgatacagtcgcaagtaaatcgtgagttgcgtttaagttttgctgatgatgtcattgaaaataatctaccccttgaaaaaaacgtggctaatttaaaacaaagcgtagcaaaattgcaccgcacttatttgcattatgcgaagataatttctagaaatagtgaagaatttgaggatataaaatgattgatgaaaaatttactgtagcctgtcccaattgcaaaaaagaagtactttggtcagaggaaaatcgatttcgtccattctgtagcaaacattgtcaattaatcgacttaggtgaatgggctacagaagaaaagattattcccggttcagaaataaccttgttaccgaaagatgaatttaaagaaaattgagagttatgaatggatagataaataaatagataaaaagaatattgagattttaatttgggcttgttagaatcagcccacttttattttgataaataaaaatatagttcgaatgaaggtagctggagaatggggaattgaccccaaaccgacgaggtaaaatctttcaggtgcgatggcgaggactgttactggacgaacccttggagagatccaatgtgcaatgcacaaaatggacgccgaaggcgcaaaagagcggtgttttttactgcttttcaaacgctcaggcaaaaggacaggggcaaaagattcttttcggatagaaacgttgcatagcgttttttctttattatcccaaaaacttttcgcctccttgtaaacacacgttattttacgaggaatacttatgtcattagagataattttatcgtctatcaatacttttgtttggggacctcccttacttcttcttttatttggtacaggtctttacttgaccttacgcttaggatttattcaaattcgttacttacctcgtgcattatattatttatttgataaagaacgtcatgtaagtaaaaaaggggatatttctgctttcgcagccctttgtacggctttagcggcaacaataggtacgggaaatattgttggtgttgcaactgctttgcaagccggtgggccaggggctattttttggatgtggttagttgctttacttggaatggcaactaaatatgctgagtgtttattagcggtgaaatatcgggtgcgagataaacaaggttttatgagtggcggaccaatgtattatattgagaaaggcttaggaataaaatggcttgccaaattttttgccgtctgtggtgtattagttgcatttttgggcattggcacttttcctcaaattaatgcaatcacgcatgctatgcaagatacctttaacgtatctattgaaattacagcaaccattattaccgcacttattgcacttattatcttaggcggtgttaaacgcatttcaacagttgcatctattatcgttccttttatggctgttttatatgtacttacgtctttgttaattcttatactaaattggcaacaagtaccaaccgctattggactaattatttacagtgcatttaatcctcaagcagcattaggcggtgtatttggatatactgttctgaaagctattcaatcaggatttgcaaggggtattttctctaatgaatccggattaggtagtgcaccaattgcggcggcggcagctcaaactaaagaacctgttcgtcaaggattaatttcgatgataggtacttttttagatactctcgttgtgtgtactatgacaggtatcgtgcttgttttaacaggtgcttggcaatcacaagaattggcaggagctgctttaactaactatgcattttcacaagggttaggaaataatattggtgcaacaattgtaaccgtagggttactgttttttgcttttactactattttaggttggtgttattacggagaacgttgttttgtttatctggcaggtgtcaaaggtatcaaagtttatcgttcaatttttatacttttagttgcctgtggtgcttttattaaactggaattaatttggattttggctgatattgtgaatggtttaatggcatttccaaatttaattgctttagttggattgcgacatattgtgatcaatgaaactaaagattattttattcgcaggaaacaaatatttgttgagccaaataatgtagctaattgagcaaaaattaaaggggctgacggcccctttaaatttctctacatcagaccatcatatcaacctcaaataaaaataaaagtgattttttataaatatgataagtagatcatactttttcatttttattcctaaaaagtgaaaaaacaccttgaaaactcctgctaagaggactattttgtaactaagaatttttctgagtggaaacgctcatcaataagcaaaagaggtaaaagctatgactctaaatatcacaagtaaacaaatggaaatcacccctgcaatccgttcacatatagaggaaagacttgctaaattaggaaaatggcaaactcaattgattaatccgcattttattttaaataaagtaccgcagggttttgctgttgaagttgccataggtacgccttatggcgatttattcgcaagtagcgagtctgatgatatgtacaaagcaattaacgaagttgaagaaaaattagaaagacaattgaataaattacaacataaaggagaagctcgccgagctagtgaaagactaaaagacttgttttgataaatgagtttgtctaaaagtagagtgaaaataaaacgctctatttattgcgtaatgaattttacttattgtatgttacctatttgaacctaccaaataagtggtgtaaatcgtggcttctcgtaagtcctaaaaaagctgatgtttaaacttcagcttttttgttagaatatatcggcgataaattttattaaggaatgaagatgaaaaaacatcatgttgacgttttaattactgaggaagatgtacgttcacgtattcaagaattaggtagagaaattacacaattctatcagcataaacacgtaaataaattggtagttgttggattattacgtggttcatttatgtttatggctgatttagtaagagaaattaaattaccgattgaaattgaatttatgactacttccagttatgggaatgaaatgacaactaatcatgatgtacgaatagctaaagatttagatggcgatattaaaaatgaagatgtattgattgttgaggatattattgatacaggatataccttagaaaaagtgcgggagattttattgctacgttcgcctaattcattagcaatttgtactctattagataagccatctcgccgagaggtagacgttcctgttgaatgggttggatttactattcctgatgaatttgttgtcggctatggtattgattatgctcaatgttatcgtaatttaggctatatcggtaaagttactttggaagaataagttaccgaaaaggaaatgtttctatcaaaaattaaacaaaaaaagagattaaaaaatctctttttttacacattctttaagaaaaaataactatatagataaaattgaaaataattagaaattatcttcaagcattgttaatttttttctcaaagcgttcagcagcagcatcccaattcaccacattccaaaatgccttgatataatctggacgacgattttggaattttaagtagtaagcatgttcccaaacatccaataccaaaatagggaaaccttcgcaaccggcaatttcttttcccattaatggactatcttggtttgcggtagaaacaacttctaatttgccttgatttaatactagccaagcccaaccggaaccaaagcgagttgcagcggctttctcaaactcagcttggaaactctctactgaaccaaaatcacgctcaatagcgtcttttaatgggccttgtaaagttgtacctgtttttaaacctttccaaaataaactgtgatttacatgcccaccaacattattgcgaatagcagtacgtttatcagcaggaacttcgactaatttggtaattaattgacccggacaaagatctgtaaactcaggtaaagtttctagtgctgcatttgcattattaacataagcttgatggtgtttactatgatggagttccatagtttgtgcatcaaagtgcggttctaaagcatcataagcataacctaattcaggtaaagtgtaagccataacaatttccttctataaaaaattctgaataataaactcagcgaattctagcaaaaaatttgatcaagatcattaaaagtttaatttttttaaaaagccctaccgtaagatagggctataatagattaagaaacattcaacgattctgtgcttttaccgctgcaacggctaccatattaataatacggcgtactgatgaagcagaagtaagaatatgtgccggtttttccacccccattaaaattggtccaattgtaattggtgttgctgtaccttgtaataaattcaagctaatacgggcagtttccatgttgggcataatcaataagtttgccgcccctttaataggactgtcaggcatcacttccttacgtaaattctccgataaagcaatatcacagtgcatttcaccatcaataatcaaatccggtgctttttcacgcacaagctctaaaacctgccgcattttaaccgcacttgggtcattaattgagccataatttgaatgtgaaacaagagcaacctgtggctctataccaaaacgacgaacttctttggctgacataatcgtgatttctgcaagttcctcggctgttgggcttgagttcacaaaagtatctgcaataaataaattaccggtaggcaaaaccagtccgtttaccgtagctggaatttcatgttctttttcaccaacaacctctttaacagtagccaagtgtgccgcaaatggtccaactaatccgcaaatcatcgcatcgactttaccaagctccaataaaactgcaccaagtgcggtcggattatggagcatttttcgtttggctccggtaggtgtcataccttggcgttttaatttgttgtaataggtatcacaacattcctcgtagtatggattattttcaatgtcaataatctcaaaatcacgtccgagctgtaattgcaaacccaattttttaatactttcctcaataatatgagtacgacctaataggacaggataggctatgcctaaggttgcaatttcttggattgcatgtaatacacgtttttcttcgccatcagttaaaataactcgctttttatcttctttggcctgtgcaaaaacaggtttcatgaataagttggttttataaacaaactgggttaatttctcaatatatgcctcaaaatcttcaatcggacgagtagcgacaccgctatccattgcagctttagctacagctggtgcaattttgacaattaaacgaggatcaaaaggttttggaataatgtaatcaggtccaaaggaaacaccgctctcaccataggcagaactgacgacttcactttgctctgctaacgctaaatcagcaatagcataaactgccgcaagtttcatttcctcattaatagtggttgcactgacatctaaggcaccacggaaaatgaacggaaagcataatacattatttacttggttcggatagtcggaacgaccggtacaaacaatcgcatcaggtcgaacagcttttgctaacggcggtaaaatttcaggttcaggattggctaatgctagaattaaaggattagggctcattgtttttaccatttcttgagtaagtgctccagcggcagaacaacctaagaaaatatctgaatcaggaatggcatcagctaaagagcgttgaccgttatcatcaatagcatataactttttggtgtcatccattttttcgtcacgacctttataaatgacccctttcgagtcacaaaccgtgatattttcacgtttcatgcctaatgaaaccagtaaatttaagcatgcaatagaagccgcacctgcaccggaggcaactaaacgaacatcttcaatttttttattaacaatacgtaatccgttaattattgcggcggctgaaattatggctgtaccatgctgatcatcgtgaaaaacaggaattttcagacgctcacgtaatttttgttcaatataaaagcattcaggtgctttaatatcttcaagatttataccgccgaaagtcggttctaaagcggcgataatttctactaatttatcaggatcttgttcatctacttcaatatcaaagacatcaacaccggcaaacttcttaaataaaacccctttaccctccataacaggcttaccggctaacgctccaatatttcctaaacctaatactgcggttccatttgatatcactgcgactaaattgcctctggaagtatatctataagcagagacaggatctgcttggatttctaaacaaggtacagccacccccggagaataggctaaagctaaatctcgttgtgttcccaatgattttgttggtgtaacttcaatttttcccggttttggaaactcatgaaaatctaaagcggcttgacgtaattgtgcatccataatttttcctcatattaactatttacttcatttcaactttactaaaaaccaatttcattataggcaaaaaaataggcaaaaaagtaacacaaaaattttatttacataatttaccaaattgtatgatatacagaatcaaatacaaaaataggcatatatttttactatatgcctattggaactaaagaacaattttacttatgtaatgtagctttgtaggttgggttcattaaattctccacagaaagaatattatctaactgctcttctgttaataagcccatttccagtacaacttcacgcactccacgtcctgttttagcacatgttttacctactatatcgccattatgatgaccaataaacggattcaaataagttacgattccgatggaattaaagacataattttcacaaatttctttatttgcagtaattccatcaatacatttatcacgtaaattcacgcaagcattcgttaaaatttcaatactttcaaacatggcttgaccaattaccggttccatcacatttaactgcaattgccccgcttcagctgcaaaagttacggtagtatcattaccaatcactttgaaacaaacttggttgactacctcaggtacaaccggattgacttttgccagcataattgaagatccagcttgtaactcaggtaaattaatttcatttaaacctgcacgtggacctgatgaaagtaaacgtaaatcattgcatactttggataattttaccgcagtacgttttaacgcaccgtgtaccataacataagcaccacagtctgaagtggcttcaattaagtttggtgcaactgtacaaggtaaaccagaaacctcagataaacgcttaacaactaattctgaataaccttgaggagtatttaagccggtaccgatagctgttgcacccaaatttacttctaacagtaattcagccgtgcgggttaaattacgcacttcttcatctaataatacagaaaatgctttaaattcttgccccactgtcataggaactgcatcttgtaattgagtacggcccatttttaagatattcgaaaactcttttgctttattttcaaaaccttgttgtaaataaagtactttagttaccagtttcataatactgttataaacagcaatgcggaaacctgtcggataagcatcatttgtagattggctggcattaacatgatccatcggatctaaaatatcatattcccctttcttatgacctaaaatttctaatgctaaattagcgaccacttcgttggtattcatatttacggaagtaccagcaccaccttgatatacatctgaaggaaattgatccatacatttaccatcaattaaaatcgcatcacaagctttcacaatcgcctgagcaattttatccggaattgcacccaattctccatttgcaagtgcggttgctttttttaccatgaccataccacgtacaaattcaggtacatcagaaatcgttacattagaaatgttaaaattttctaccgctcttaatgtatgaatgccccaatacgcatcagctggaacgtcacgttcaccaagcaaatcaatttcttttctcgttatcatatttctttcctttttaatttttcagactaaagaatgtaagtcattataggatagatagtcgtttaaaaatgtgatcccgatcacttttcagcactcctctcaccaatatattttttataaaattcattagttttttttatggaaaattaaataaaaaatacccttgaaagaaccaaaatatcccccatatagggtgagctttaattttttattaattattaataaggaacccaaacaatgaatattcgtccattacatgatcgtgtcatcattaaacgtgaagaagtagaaactcgctctgcgggtggtattgtcttaactggctcagctgcaacaaaatccactcgagcaaaagtattagctgtgggtaaaggtcgtattttggaaaatggtacagttcaacctcttgatgtaaaaattggtgatactgtgattttcaatgatggatacggcgtaaaagcagaaaaaattgatggtgaagaagtgttaatcatttctgaaaatgatattttggcaatcgtagaataaaaacaaattaaattaataggaatacagaaaatgacagcaaaagacgtaaaatttggtaatgatgctcgtgtaaaaatgctagcaggtgtgaatgttttagcagatgcagtaaaagttactttaggacctaaaggtcgcaacgtaattttagacaaggcttttggtgcacctactattactaaagacggtgtgtctgtggctcgtgaaatcgaattggaagataaatttgaaaatatgggtgcacaaatggtgaaagaggttgcctctaaagcaaatgatgctgcaggcgatggtacaaccacagcaacagttttggctcaagcgattgtcagcgaaggtctaaaagcagtagctgccggaatgaatccgatggatttaaaacgtggaattgataaagcagttaatgcagtggttgaagagctaaaaattctttctaaaccttgtgaaacgtcaaaagaaattgaacaggttggtacaatttccgcaaacgccgatgaaactgtcggtaaacttattgctcaagcaatggaaaaagtcggtaaagagggggttattaccgttgaggacggttccggtctttcagatgaattggatgttgttgagggtatgcaatttgaccgcggttatttatcaccatacttcattaataaaccggaagccgcaactgttgaattagataatccgtttattcttcttgttgataaaaagatctctaatattcgtgaattattaccggtcctagaaggtgtagcgaaagctggtaaaccattgttaattatcgcagaagatgtggaaggcgaagcacttgcaacgttggttgttaacacgatgcgtggtattgttaaagttgctgcggttaaagccccgggatttggagatcgtcgtaaagcgatgttacaggatattgctatcttaactgcaggtactgtcatttcagaagaaatcggaatggagcttgaaaaagcaactcttgaagatttaggtcaagcaaaacgtgtggtgatcaacaaagataacacgactattattgacggtattggtgatgaagctcaaatcaaaggtcgagttgctcaaattcgtcaacaaattgaagaagcaacctccgattatgataaagaaaaactacaagagcgtgttgcaaaattagccggcggtgttgctgtaattaaggttggtgcggcaactgaagttgaaatgaaagagaaaaaagatcgtgttgatgatgcgttacatgcaacgcgtgccgctgttgaagaagggattgttgccggtggtggtgttgcattaatccgtgctgcaacaaaagttgcaacaacattaaaaggcgataacgaagatcaagatgtaggtatcaaacttgctttacgtgcaatggaagcaccacttcgtcaaatcgtaaccaatgcgggagaagaagcttctgtagttgcaagtgcggttaaaaatggtgaaggaaacttcggttataatgctggtacggagcagtatggtgatatgatcgcaatgggaattttagatccgactaaagtaactcgttccgcactacaatttgctgcatctatcgcaggattaatggttacaactgaatgtatggtagccgatctgccgaaagaggagaaagctgatctgacaggcggaatgggtggtatgggcggaatgggcggtatgatgtaattctccccatattccatatctaatcattatgttaagaagggtcgtcagaccctttttatttttcaaaaaacgtagaccttaattattagctatctagaagtctagattgttattttgcctattttttattagaatactcaatattactaaggttattaaggatcaacaaaatggcagattgggacggaaaatatattagcccttatgcagaacatggtaaaaagagtgaacaagtcaagaaaattaccgtttctattccaattaaagtattagaaattttaactaatgaacgcactcgtcgccaactccgtaatttacgtcatgcaacaaatagtgaattattgtgtgaggcgttcctgcatgcttttaccggtcaacctttgcccacagacgaggatctattaaaagaacgtcatgatgagattcctgaaagtgcaaaacaaattatgagagaattaggaataaatcccgatgactgggaatattaatagattaagtttggtaagttatttcagcaagtgcggtcgttttgaccgctttttcgctttttattagtgaatttcactcgggaatgttacaatccgctaccgttataacaatagagataaatacaatggctcgtacaaaaaaaactcgtcgaataacagatattatgcccatgcgtaaaacagataaacgtccggaaaatctgtcacgccccggtaagaaacttactcgttatgaacttgatgctaaatctcgtgaagaaaaaaagaaaaaaaaacgtaaaggactaaccgccggttcacgtcatagtgcagtagatacaagtaaaacaatcgtacttaatgaaaaaaaagatcctcgtgttgggagtcgtaaaaaagttcctcttattgttgaatttgtgaataaacctgaaaaaggtatgtttattccttcaggtgctttagaggaaaaagcgaaaactattgatccgatgctggaactgacacaactcgaaaataatgaaagtttaaatcaattattagatgagcttgatgcaggtaaaaccttaagtaaaaaagatcaaatctttgtcaatcaatgcctagaccgtattgctcaacttatggctgaacttggaattgaagaagaaagtgaagatgatttgtaccgcacttttgagactattgatattaaccaatttaaataagctatgtggatcacaattttaatcattctcggcggattaattattagcgttatgcttggttacgcaatatatttattgctcgttttacaaaagcagaagaaagtttttttgcaagcaaaacaggctagactaaagcgtttaaaagaaagttgtgaaattatcgctaatgcaatgcaaagtggagaatgcaatttatctgaaggtgttatccgtctaaaaatgttgcttgaaccgttagggcattcattgaaaaattacacttcaatgtaccaactctatgaagcagtaatggatatgccgacccatgatgctcggcgaacattaaagaaaaatgaacgtatgcgtttagatttacaacgtgaacgtgctgaagctgatttagaacaaaacatcaaacttgaaattcagcgactattaaattacctaaaagaatctaaggaaaaataaatgtcagaaattatctgggatttagcattaatccaaaagtataaccattcaggtccaagatatacctcctatccaaccgcacttgaattcaatgaaagctatactgataaagattttcagcaagctgctactcgttatcctacacgtccgctttctttatatgtacatattccattttgtcataaactttgttatttctgtgcttgtaacaaaactattactcgtcatcaacataaagtagagatttatcttgattatttagaaaaagaaattcaaacaagggctccgttatttcgtcatcgcatcgcaactcaaattcactggggaggcggtacaccgacttatctttcagaacaacaatctgcacgtttaatgcaaatgctgaaagagaattttactatttcagataaggcggaaatcagtatagaaatggatcctagagaaattgagctttctatgctggatcatttatacaaaattggttttaatcgtattagtatgggggtgcaagattttaataaagatgtgcaaaaagcagtgaatcgtgaacaagatgaagaatttgtgcgtgaattgttgattcgtgctcgtgagttaggttttcgctcaaccaatctcgatcttatttatgggttaccgttccaaaccgtagaaagttttatgtttaccctacataaagttatcgaactcaatccggatcgtttgagtgtatttaactatgctcacttaccaagccgtttcgccgggcaagcgaaaattaaggataaagacttaccaacacctgaaacaaaactaacaatcttgcaaaaaactatcgaaacgttaggacaagcaaactatcgttttattggcatggatcattttgctaaaccggatgatgaattggcaattgcacaacaaaaaggaattctacaccgcaatttccaaggttataccacgcaagaagaatgtgatttattagggttaggtgtttctgccattagtttattgggcgatacctatgctcaaaaccaaaaagatctcaagcaatactatacccacgtagaagaaactggtttagcattacacaaaggtttggtgatgacgcaagaagactgcctacgccgtgatgtgatcaaacaattaatttgcaattttaaattagattttcaaccgatagaacaacaataccaaattgatttcaaaacccattttgctgaagatttagctttgctccaacccttagcaactgacggcttagttgatattaatgacaatgcgttacaagtatctgctaaaggtcgtttgctcattagaaacatttgcttgtgttttgatacatactctagacaacaagcaaaaagacaacaattttctcgaattatttaacgaaaaagtgcggtcaaaattaaccgcacttttttaacctcgctgtgcatttttcataatgcgatctttcgttactttccattcacgatctttaatatcttcacgcttatcatgtaattttttcccttttgctaaacctattttcacctttgcccaaggacctttccaatataatgaaagtgcaacaatagtgaaaccatctcgatttgctttaccaaataatgaagccaactctttctggtttaataaaagtttacgtgttcttgtgggatcgcaaacaatatgcgttgaagcaacacttaacggctgaatggttgcaccaaataaatatgcctcaccatgcttaaaaataatataactatcgccaatactcgccttacctgcacgcatcgatttaacttcccagccttgcaaagaaagaccggcttcgatttcatcttcaataaaataatcgtgtcttgctcgtttatttaaggcaatcgtattagatgctacctttgcttttttctttgtcatataaattcatatctcattaaaaatttttcgcattttacccaatctaagcaaagatcgcaaaaaggcttgcattacatcgcattctctataacaatgcggatattcttgataacccgttacgcaaaatatgaaatataaaaatctacgagattttcttgaattattagagaaacaaggtgagctcaaaagaattacacaggaaatcgacccttatttagaaatgacagaaattgctgaccgcactttgcgtgccggtggtcccgcattactttttgaaaatccaaaaggctatgaaattcctgtgctttgtaatttatttggtactcccaaacgtgttgctcttggaatggggcaggaagatgttaccgcactgcgtgatgtagggagattactggcttttctaaaagaacctgaacaaccaaaaagttttaaagatttatggtcaagtcttcctcaatttaaacaagtgctaaatatgccaacgaaagttttgagtaaagcagagtgtcagcaaattgtattctctgatgctgaagttgatttatataaattacctattatgcactgttggaaagatgatgttgcacctttagttacatggggattaaccatcactaaaggaccaagtaaaaaaagacaaaatttaggtatttatcgccaacaattaataggaaaaaataaactcattatgcgttggctatctcaccgtggcggtgctttggattttcaagaatggaaagaaatacaccctaaccaaccatttcctgtttcggttgctttgggtgcagatcctgccaccattctaggggcggtaacgcctgtgccggacactttatcggaatatgcttttgccggattgctgcgtggtaataaaactgaagtagtgaagtcaatcagcaatgagcttgaagttcctgcaagtgcggagattattttggaaggttatattgatccgacagagaccgcacttgagggaccatacggagatcacacaggttattataatgaacaagaatattttcctgtatttaccgtaacacatatcaccatgcgtaaagatccgatttaccattcaacttacacaggtcgtccaccggatgagcctgcagttttgggtgaagcactgaacgaggtttttattcctattttgcaaaagcagtttccggaaattgtcgatttctatcttcctccggaaggatgctcttaccgtcttgcagttgttacaataaaaaaacaatatgcaggccacgctaagagagtcatgatgggagtatggtcatttttacgccagtttatgtacacaaaatttgtgattgtctgtgatgacgatataaatgcacgagattggaaagatgtgatttgggctattacaacacgtagcgatcccgcccgagattgtacaattatagaaaatacgcctattgattatcttgattttgcctcaccgattgccggtctcggctcaaaaatgggaatagatgcgacaaacaaatggattggagaaacgcaacgtgaatggggaaccccaattaaaaaagcccctaatgtagttaaacgcattgatgatatttgggagagtctaaatatttttgctcccaaataaacagcaaaaggcaaataagtgcggtgcttatttacctgtttatttcaaacgctcaaatccggctttaagatcggcaataaggtcatcaacgtcctctaaaccaatatgtaggcgaattaatgtaccggttaatttgcgttcaatattaggtctaatcctagcgatttcttccggttgattgcataaaatcagcgattcaaatcccccccacgaatatgccatagtaaaaatcttaaaatgatccataaaattttctaacgcctgttgagaaagttttttatttagttcaaaagaaaataatccactggaacctgtaaaatatcgcttaaaatattgatgtcccggacaacttggcaatgccggatgataaacagtttttacttcaggctgttccagtaaccatttagctactttaattccattttcttgatgctgttttaagcgaactagtagagtacgaataccacgggctgtcatgtaagcggtatcagcatcgaccatctgccccattaaataagaattttcacgtaattgttcccaacaacgtgcattagccaccgctgtaccaatcatcgcatcagaatgcccaatgagatattttgtccctgcctgaattgaaatatcaataccgaaatccaaagccttaaaaaatacaccagcactccaagtattatcgatcataactactattttaggattgatttggcgagcagcttgcacaatcgatacaatgtccggtatctccatagtaagtgaacttggtgcttccaaaaacaagactgtcgtatttggttgaactaaatccgcaattttttcaccaattaaaggatcataaaatgtggttgtaattgacattttctttaaaattatatgacaaaattcttgcgttggttcataagcagcaccgctcattaacacgtgatcaccggtttttacaaaagctaaaatagcattacttaccgccgccgcaccgcaaggatagagatagcaaccctcaccaccttccaattcacacattaattcttgcaaagcaaaatgtgtcaatgttcctcgacgtccataaaataatccaccttttgctcgattgatagttgcttgttttttatctgctaaagtatcaaaaaccaatgaagatgcacgctgaataacagggtttaccgcatttttacatactcgtttattacgccctgcatgaattgttgatgtggtaaaagaagttgtattactcatagaaatatccattttaaacaaaaatcaagattataataattgatttaatagccaaaaactaatacaaaagtgcggtcttttttcataaaataattgtgcgaatttgctttagaatgcaaaattcttaataacttttataggagatttttactatggtattagttactcgtcaagccccagattttaccgcagcggcagttttaggcaatggtgaaattgttgaaaaatttaatctaaaacagcatattgctgggaaagcggcggttgtttttttctatccaatggattttacttttgtatgcccatctgaattaattgcatttgatcatcgttataaagaattccaagatcgtaatgtggaaattattggtgtttcaattgattctgaatttacacacaatgcatggcgtaacacaccggtagataacggcggtatcggtcaagtacaatatgctttagtggcagatattaagcacgaaatcgcaaaagcttatggcattgaacatcctgaggcaggtgttgcattacgtgcatcattcttaattgacaaagaaggtgttgttcgtcaccaagtcgtaaatgatcttccattaggtcgtaatattgatgaaatgttacgtatggttgatgccttacaattccatgaagagcatggtgaagtatgtccggcacaatgggaaaaaggcaaagaaggtatgaccggtagcccagaaggtgttgcaaaatacttgaaacaaaatgcagataaactttgatctcatcaattttaactaaaactagccccgcacttatgtggggctatttcattataaatctagtcattcttataagatcctctgaaaaataggaataacattattagcaataattttccatgaggatatacaaaaaagctcccaaaataaattttaggagcttcaatttttatttcataaataattagcgacgtaagcctaaacgtgcaattatttctgaatatttagcaagatctgtacgttttagatagtctaaaagtttacgacgacgagagaccatgcgtaataaaccacgacgaccgtgatgatcttttttatgtgtagaaaaatgagcttgcaaatggttaatttgtgcagtcaataatgcaatttgtacttctgaagaaccggtatctttcgcatcacgaccaaattcagcaacaatagctgcttttttttctgtacttagagacataaacattccttatactaaaagggttgataatacatcattcgccgatctctaactcagcgatgacaggaactgcagattttatctctcgattataaaaaaagcaataaataattactcaacatacaaactagacctacttacaatgttaccgcattatttatgcgtattatgcgtaaaaactaaaaatgaaggatatatttttcttgattttatagcaagaaagataaagaatattaactaataggattataattaattaagatatttaattttagataagtggcataagtggctaaaaatgttccacataaagtaggataaaaattttctcaatctattcaatcaaatttttggagatttatattatgacaatacaaccagatccaacttctgtaaaaacgcactttcaaggcaatgacaaactattgtttggtatgattatgggagtgattgccttttggctttttgcacaaaccacgttaaatattgcacccgatatggagcaagatttaggtgttaacaccagtattatgaatattgctgtatcaattacagctttattttcggggatgtttattgtcgttatgggcgggcttgcagatcgtatcggctgtttaaaaattttaaatttaggttttttattgagtattattggggcattgttaattgcactggctccatctggtgatttagctgtcccactattaatgttagggcgtattattcaagggatatctgctgcttgcattatgccatctagtttagctttagtaaaagcctattgggagggtgaagctcgtcagcgtgctattagtatgtggtctatcggctcttggggtggttctggtttatgtgcactcttcggtgggttagtatctcaaaatctaggttggcgttatattttctttgcttgtgccgctttatctttattaggttatgttatgtgtcgtggtaccccagaattcaaaatggaagatgatggaaaaaaacataaatttgactggggaggtgttgttacctttatgattgccatgatcgctttacaagtattggtgactcaaggtggtgatttcggctggacaagcatgaccactatcggtttattgctagtgacttttgtgtcaatcgtattatttttatggattgaggagcgtgctgataaagcgtttgtggacttttcactttttaaaaatgcgacttacactggagcgactatttctaacttcttgctcaacggtgtagccggcatgttaattgtatcgttacaattagtacaattgggcggtaatatgactgcacaatctgccggattgctcactattggctatgcgattgcgattattgcttttattcgtgtgggggagaaattattacaacgttttggtgcccgtaaacctatgatttggggctgcctaattacaggcttttctattgctttgttattaccaacgaatatgatgttggatcaatataagattatcgttgttatttcttatatcttatttggtataggtttagcattttatgcaaccccatccactgatgccgcattatcaaatcttccgcctgaacaagcgggggcgggttccggtctctataaaatggcttcttcactgggtgcggcatttggtgttgctatttcagcggcaatcttcaccgcactccgtgcagagaatgccagtgtatcttggttaaataacatcgtcccttttgttggtcgccaagataatattgctattcgtgaagccgctattattgcattaatgtttaacttattgatgatttttggggctattgtgtctattatgttgactgtgccaacgggcaaaaaatcatcctaaccacagtatttacttgatattcaggctacctaaatcattccggtagtctgaaaccctaaaaaaccgggttcagtaaagaaaaaatcatgactatattatttacaatctatcaccccaagcaaatcggaaaaagcaacgtatattttcgttatatctaccagccactatatatttagtcaaaaaaatctacgtctaaatttattggcggtttcgtccaattttggggtatagatcattttgaccgttctttttattttttgcataatagccactttatttttatccgtctcttacgtatggagcattctatgctgacagaacaatctaaaaaacataccgcacttttgtcttttttacctgtattactcctaattgctattgatttctttaccatgagtttacaagctcaagcaaaagcaatttcccatttgagtttagctgtattagttacacaattattatgtattttagtgtttgccaaaggtgaaatttgcaatggtcagcgtttcagattagtaaaggtaaacttatattttttgatttattgggggttatggctgtttatcagtttattttccaattatcactatgtattaactgatattgtatgtttgtgtggcattgctttaactttggctatttggcaacaacctcaagatttgcaaatgcgtaagtcattgttggttttaggaacacttgtgggagttttaggtatagtaacttattgtttaatgtttattgatttacctttactttatttttctcaatataatccagtagctcaagcattgctaggcatcatattagcgaatttattgctagtcatcgctaaaaatcgtttacaaggctttattatcttattgccttttttgatgctgattactttattactgaatgcaattattgtgttaggtattttgttttttgctatatcacaacaagttgtattttctaatgagttttcttggggactttattttattttacatttacttgttactggcattattgctatacatttattttacaaatggaaatttgaatattacaccttgttaataatgagttttattgtaatgagttttcctttatgggtaagttttgcctatgtgttttaactaaaacaactgcctactttttggaaatgattgatcattgatgagtatgtatgttatcagataagagaaaagcggacaaaatgctttattttgtccgctttgtgtaatattgagaggactaaatgttaagtacagcaattaaagctaaaatagagtaaagtactgataatccgtagaaaataatcccacctgctggaatatgaagtttaaaatcatgtgtgccatggtgaattcgatgcattgccccccaagttggaaaaactaatacaactaatagaatcagtttacctaaccaagaaccggcaaaagcaataatattgtctgcaccgttttcgattaatccaaaaggtagtaatagacctaggataaaaatcaatatagggaagacaattgcacttactgtagtacctgcaccgaacaataaccatacaacaggttcgttagagcgttttggagtttctttcatcttggtctccctatttcaagtaaattagcactaaagcaagaatacttactacggctgtaacagcccacataccgatagtaataacattcggatttagtttttcatttttgtacacgatatttagcacttttggcgtcatgaagaaatacgtaactgtattcaaaatggctgctgccaaggcgataatattcagaataataacaattggattttgtaagaaaggaataaaatccgattgcaatccatctttttgacctaggcagatcacgccataaagtaataccaagctaaaccataatgatggaattgctgttgcttcacgcataatgtaaagtttgtaaaaatctagctttttccaccaagttgcttttacttcccgcacatatcttctgcgtttacttgttactgttgtcattttacactccttacttttgcggttttaacattgcaatgacgaaatcttttgcactttcgactttaccttggttgacaccagaagcaggatctacatgtttagggcagacttcggaacaataacccacaaaagtacaactccatacgccattcttaccgttaataattttcatccgttctgcttttccgtgatcacgattatcaagattataacggtgagcaagagttaagactgccggaccgacaaattcgggatttaagccaaattgcggacaagcggcgtaacataatccacagttaatacacatagagaattgacgatatttctctaattgagccggcgtttgtttagtacgactttccgccaattccgatgacgtatgtggtttaccatctaattcaggtgctttattgcctataatatatggtttgatactctccaaactttcaatgaagtgactaaggtcgaccactaaatcccgttcaatcgggaagtttgctaatggttcaatacgcatatgaccactataatcacgtaaaaaagttttgcaggcaagtttaggtttaccgttcaccatcattccgcaagaaccgcagattgccatacggcaagaccatcgataagaaagttccggttctaatttatccttaatataacctaaagcatctagtaaagatgtttgactgtcataaggaacttggtaagtacgtaagtatggctctttatccgcctcaggattataacgcaatacttcaatattcattattgcttgattagccatttgcttgctccttagcttttgcagccgcttcttgtgcttcagcttccgcaccgtaaacacgttttgctggttgagatttggtgattttcacatcgctgtattcaatccgtggggcaccatcagcattataatatgctaaagtgtgttttagataattcacatcatcacgctcagtatagtctaaacgttggtgagctccacgagattctttacgttcaatcgcagaattagcaatagattgagcaacatcgagaatataacctaattcaacggtatagagaacgttggtgttaaatacgcttgaacggtctgcaatacggatatgtttataacgctcttttaattctgcgattttatccacggtttgttgcatgctttcttgtgtacgataaatgccgcaaccttcttccattgaatcgcccatttcatcacgaatttgcgaccaagattctgttccttcttgattgtataactcttctaaacgatggataacatcttgagcttgagcatcgaccgcacttcggttagcaggttgtgcttcaattgcacgctgtgctgcatattcacctgcaacacgtcctagcaccactaattctgctaatgaatttgaacctaaacggtttgcaccatgtaaaccagaagacgcacattccccaacggcaaataaacctttaatacgggtttcgctattgaagtccacttcaataccacccatggtgtagtgtacgacaggacgaacgggaattggtgctttggcaggatcaacaccttcgtaagcattggctaattcacagataaacggtagtcgttcatgtaaatatttttcccctaaatggcgaagatcaaggtgaacaacatcaacaccttttgctgtttttaacgtattgcctttacgccattcttgccagaaggcttgggaaactttatcacgaggacccaattccatgtatttattttccggttttccgataggtgtttccggtccgagaccataatcttgtaaatagcgatagccatctttattcaccaaaataccgccttccccacggcaaccttcagtcattaagatacctgtattcggtaagcctgtcggatgatattgaacaaattccatatcacgtaacggcacaccatgacgatatgccatcgacaagccatctcccgtaacaatacccccgtttgtgttgaaacggaatgcacgacaaccgcctcccgttgcaataatgaccgcattagcattgatttgtactagagtaccttccatcatattcatcgcaaccataccacgagcatgaccgtcatcaactaaaatatctaatacgaaatgttcatcaaaacgctgaatttgtgggtactgaatggaaatttggaagagagtgtgtaacaaatggaaaccggttttatcagcagcaaaccaagtacgttcaattttcataccgccgaaacgacgaacgtttacatcaccatcaacttttctgctccaaggacagccccaacgttctaattgagtcatttctaccggagagtgttgaacaaaatattccaccacatcctgttcacacaaccagtctccaccggcaacagtgtcatggaagtgtttatcgtaagagtcctcatccttaattactgcagctgccccaccttctgctgcaacagtatggctacgcatcggatatacttttgaaactaaagcgatctttaaattaggatttgcttccgctgctgcaattgccgaacgtaaaccaccaccaccggcaccaacaattgcgatatcgacattaactgtttgcacgatattcctccaataatagataagagtaaaaattaatccctaacgggaaatcacaaaagcaatactattctgccactattttaaaagagatataactcttttttgttaatttaagctagaaaattttaatttcgtgatctaactcaaaactatatttgaaatagataagaaatattctcattaatttaaaattagatgataagcaatatcatttattaacaaaaacatagcgttactattagaaaaattgatttgtcgcattattatttttttcaggtagaatatttcaaaaaatttataaaggattttattatgtctttgaatgaacaatggcaacctagtgcctcgatccaaaatttattggcaagagcaaaaattattgcggatattcgtcgtttttttacagagcggggattgttggaagtggaaactcccgtattgagtgaatttggcgtaacagatgttcatctttcgactttcagcacagcctttacatctccgtttatggaaaagtcaaaaactttgtggctaacgacaagccctgaatatcatatgaaacgtttattggcagctggaagcggtgcaattttccaattgtgtaaagtatttcgcaatgaagaaagcggcaaaaagcataatccagaatttacaatgcttgagtggtatcgaccgcactttgatatgcatcgtttaattaatgaggttgatgatttgttacaacaaactcttgattgtgaaccggctgagatggcgagttatcaatttgtatttcaggaacatgtaggtatagatccattgtctgcaccgattaatgaattgattgaaaaagcaagagaatgccatttggacggtgctgaaaatgaggatcgcgatacgttgttacaatttttatttagcacgcttgtcgaacctaatattggtcaaaacaaacccattgtagtttatcattttccggcaactcaggcggcccttgcacaaattagttcagaagaccatcgtgttgcggaacggtttgagttttattataagggaattgaattggctaacggttttaatgaattgactgatgcacaagagcaagaacatcgctttaatcaagataatcgcttaagagaacaattggggttaccacaacatgagattgatcatcgttttttaggtgcattacaagcggggttgccaaatacagcaggggtggcattgggagttgacagactcattatgcttgctttaggtgctgaaaatatcagcgaggtgatttcgtttaatatagattgtgcttagaataaagtttttgtatcacattgcgaaaaagaatttttacaaataacggtaaattattctttcaaactaatttgatgtgaacccaaagattgtttacgattaatcattgcatgaactactaattgtgcagttttaatagcatgataaatttcaatactgtgaatctttttgagatcaataggacaatttttttccaaatgttgtagttgtgtaattaaacattgcaaattttttttagttctatacacattggcaaattgattcattaatgatcttacttgtcgcaatatttcacttgatgagtgagcggattttttctcttgattggctaaatgttgtaaatagcgtattccctttaacacataatgttctttattttgtgtagaaaagtgcggtacattttccacaactttttgtatcgctcttttggcaaacacgaggctaccgcctacagagttccctcctagacgatttgctccttcaatacatgcagaaacttcccctaccgcaaataacccctgtactgctgtttgggcgtattcattgatttcaattccaccgttgcaactatgagcaaaaggtcgaattattacctgatctcgtaataaatgaatatccatttctttttccagccaagttaaatagacttgataaaattccgttttatcatggtaaagttcgggagaataatgtagatacactcctttctcagtaggattttcaatcaaatgtttcattattacgagatcaaattcaacactttgaaaatccacactaaaaggtgcatagctactacgttgttgtatcattttttgaaattgttgcggtgataaatgagaaaataaattcttacctttgctatcagtaacctttatcagatattttaaagtatgctcaccgaacaatactttatacttaggtttaacaaaagcaggaatgaattgaataaattcaagattggttaattttgcacctgcttgataagctacatagtgggtcgaacctattatatctgcgggatagagattgtcttgatacaaccccgaaataccgcctgtggctaatatgatattattcgtgtagcaaaaaatatagcgaatctcaccgctcttttgttgagcaaaaatagcacctttaatttgattttgttcagtaacaatatgtaataaaacagagttttcataaaattctatttggtgctgaattaaaatttgtttagcccgtttagcactttgtttccagttattaattaaatagatcgggcgagtatagtatgcaaagcaagcagggcggttatcttgtcgtagccaaggagtaaatccaattttactcaatagctcaatagcttgtggtgattcttccacataagccctaacaatcttaggattatttactccacaagcgactctctcaatttcttgttgaaagagaattttgtcatcggaatcccctgttatttgaataccaagtgtcgcttttagcggaaaaaaacttgcacctccacctatgattgatttgctaattaaaatcggattaagtccttttgcttttgcctcaacacagcatgctaaccctgcaataccagctccaacaatcaataattccgtttcaatttggtggtgaaatttaatatttgtcataatctataaatcttttattaaagataaattcaatgcccacatcacaaaaatatcagcaatatcttctgcttaattaactactacaataatgatggtgctgcattgagcaaaattttggtatattcctgttgtggattatcaaaaacgtccattgcatcaccttgttctacaatcaagcctccattcatcaccacaatacgatcagatacttgacgaacagtttgtaaatcatgagagataaacaccattgcgagatttaactcttttttaagatcggcaagtaaatttaacacttgagcccgtacagacacatcaagggcagaagtaggttcatccgctacgattaactttgggtttaatgccaatgcacgagcaatagcaactcgttgtttttgtccacccgacagtcgtgtaggttcaaccaatgctgcagagcgaggtaatcccactcggaaaagaagttcatacacccgtttttcacgttcatgggggtgcagtacattatggatattcattggatcttttaatatatctattactcgcattcttggattaagtgcggtggcaggatcttgaaaaatcactgaaacttgtcgtccgaattgtttgcgagcctctgcacttccgtatttcatctttaaaccgttaaattttactgtgccagaagagggtttttgtaaaccaatcataacattggcgagcgttgatttaccgcaacctgattgtcccactaaacccaaagtttctcctgcctgaatatttaggctaataccatctatagcagtaaattttttcggattaaatattgaaccatcacgggaaggaaattgcaccacaatatcttgtaattcaatgattggttgtttttttaacactttcatactcatgttttaattctccaaatgcgatgcccataaatgtttcggattatcttctgcttgtactaatttcaaatgttgatttggatttgcattaggacgaagagaacgactggcaaatcgatctccttcagcaaaatcaaaaggcgatggtacactgccaggaatttgatacaagcgttccgctctacactcagtagaaagtactgaacccagcaaccctctagtgtattcatgcattggattcattaataatgaacttgttggagcgacttctactacctgccctgcatacattactgtaatatgatgagcgatttgtgctactaaggctaaatcatggctaacaaaaaccatagcaaagcccaatttttctcgtaattcattaagtaatttaattacttctgcctgcactgttacatcaagtgcggtagtaggttcatcagcaatcaataatttcggttctctagccaatgccattgcaattaatactcgttgacgttgtccgcccgataattcgtggggatagcgatttaacgttttttcaggctctaatttaacccatcgtaaaagtgtttccgcacttttttttccgccacgctgaatcagttgtgccatttgatctttaattcgcattgatgggtttaacgcacttaaagcatcttgataaatcatagaaatttcgtgaccacgtaaatcatttaatttatctgttttcaataaatcatgttgatttcctgcacgatctgtaaaaagtatttctcctgtaatcttggctgttttaggcaataatcccataatggaaaatgcagaaattgatttaccacagcctgactcgcctaccagccccatagtttcaccttcatgaacagtaaaactaatattatccactagtggaatatcaccataacgatttggaaaacgaatagataaattctttacttgcaaaattggcttcattgctgaattaagttgcattctatcagtacgttccgattctttttgatttaattttaataaataacgtttaagtgctaaactttccgccatagcttcttgtacatcggtagcaagaggctttgatacatcacctttgttatttggattacgtttaagttttggattcacgagagcatcagttagtccttctgacaaaatattaagtgataaaacggtcaacaaaatcattaatccagcaaaggtagtggcccaccaaaagccacttaatactaaatttcgaccttcggataaaacatttccccaagatggataagggggttgtactccggctcctaagaaggaaagagaagcttccaatacaattgcatctgctaccatcactgtagcaaaaaccaaaacaggggcggcagtattgcgaactacatgctttaataaaatatagcttctactgccaccaattactcgctccgctctaatataatcttcttcccactgagaaactacattagctcgtacaacccttgctaactgtggcgtataaactactgcgatagttaaaataataatcggaacagagttaccaaaagtagccaataataccgcagctaatgcaattcccggaaatgccattaaaatatccattagacgcatgatgacttcattaccaaatttactcgctgtagcagcggttgcacctagtatgctaccaaaaattattgcaaaacctaccgcacctaagccaataaacaatgatgttcttgcaccaaacactaaacgagagaaaatatctcgtcctagacgatctgtgccaaaccaatagtcactatttggtgcttgcaccggtcgtaaggtttgtaatggatcataaggagaaacccaaggtgcaaaaatagcaattaatgcaatcaacatgataaacattaaagcaattttagaggccattgataacgctttgaatcttgctccgccttgagcaagtctttcggctaatccttgacgaaacatcataaactccgaatttttggattgatcacaaggtacaatacatcaacgataatattgaccaatacaaaactaaaggcgattgttagtacaacaccttgtactaaatgcaaatcatgattgacgataccgttaaaaattaattttcccatacctggcaggtcaaaaatttgctcaataactaccgcacctcccagcaaataaccaattcttaaccccaatacagtaacgggggtaatcaacgcatttcgtaatacattatgacgaataacggttgcataaggaacgccattaccaatggctgttcgcacataatctttatccatttcttccaccatcgtagttcgtacaacccgaattagagatgcacacacaggtacagctaaagcgagtgaaggcaaaatcatcgaataaaaataaccgctcggatcttcactaaaagaagtaaatccgccggaaggtaaccaatccagttccagtgcaaaatattgaattaacaaaatcccaagccaaaaagaaggtgttgctactgcggctaccgataataaacgaataatttgatcaatccacgtatcacggtaaagtgcggcaataacccctaaagtaaaggaaactattgcagcgaggaatacaccgataaaagtcagctgtaaagttaatggaaaggctttcgcaatcaaagaagtaataggttgttcgggcggtgttgtcataccgaaatctaagtgaattaaatttccgataaaacgaaaatattgcacaattacgggatcatttaaaccgtgctgttctcgataaagttgctttgccgcctcacttgcaccttcccctaatgcaacagtggcaggatcacccggtgtaaattgcaagataataaaaaccaaagcactcacacctaatatcattatgggtaatgccgctaaacgacgaagtaataagcgaaagacaatttccattatttttctccaactatacaaaccaagtcagtagaatgaatctgctgtcaataaagataggggctgttaatcataaccacatataaatgaccgcactttctgctcattaaaaacaagcagaaagtgagaaaagttaattatttgcgacctacaccaataaatgaaagtccggtagttggaattggttggaaaccatccagtgatttgttattccaagcggttggtaatttacggtgcaaaattggataaagcggtacttgttcagcaataagattaatagcctgagtccaagccgcttttgcatctgatggctgttttgctttaattgcatcatcaagtaataattgcaatttcgcatattcaggggtatctgaccaaccgaagcgttttttcggccaaacatcaccacgataccaccagctcaataagagatccaaatcgttgctaaatactgatggatcccccggtgccattacgacttcataatttcctttgtctacgtaaccaccatacaatgctccagattgtagatgctgtaaagttactttcacacccggaattttattccaagattctaaaactaaaggggcacattcttttatccaagaatgatctgtagaaagcaattgaaactctaatttattcagacctgcttcttttaaaagtgcggtggctttttcaggattataatcatactgggttgaagccttgacataatcaggatgcgtatcttgagtgtaagaagtggcagcttttgcattacctaagaatacaatatcaattaatttttgtgtatccagtgcatagtgtaaagcttgacgtactttgggattgttaaatggggctttcttacaattaaacattaagaataacaatccgaaagattgcacggattcaaccgcacttttacgttttaagcgagatgcgtctaaataaggaacactttccattgcttgagtacgtccggactcttgtgccgctgtgcgagcggcatcatcggatagtaaaaaccatgtcattttttctacacgagcaggatatggaccgttataagcattgtgtgctgcaaatacaatgcgatcgtcttttacggctgaaacaaatttatatggtccggatcctaccggatttgcatcaaataccgtttgtcctacagcctcaatcacatgtttaggtacaatttttacaatacctaatcgcaatttaaaaagagaaaacgggtacttcaacttaaattctaccactgtatcatctaaagcgttgactgaatcaataaacggaatgaattgtataaatagtgaagcattttttggatctaaaatacgctgataagaatatactatatcctctgtggtaacaggtgtaccatcgtggaaagtcgcaccgtcacgtaatgtaacacgccatgttatatcatcaacttgttcaggttcttttgcagctaaggcgagataaggttcacgggtggcagggtgtaaatccactaatccttcaaaaaagtgcatgttggcggcaaaggaagaggctccactggaagtggacggatcaaaaccggttgataggggataagctattcctgcttcaatgctactacctgttgttgaagtggccttcgccttagaaacaaaactacctaatgtaccgctaaaggcaattcctgcaccgacaccagccaatactttcatgaaattacggcgagattcattttcaatgtaatttgtcatacatgctccttaaaagtctattttgcacacacttattgagattaatacaacgttccttacacttacacagaatatcattccctaaaatgaagtaaattaatcacaatataaattaaaatgaattggattaatcataatcgtttagagcaaacagtcaagaacatatgtaaagtaaaatctatgtttgtgaactaggtcacgaaataacggaaatctcaatttgattaaagagttaactactatctaaaagcccctgtcagctatagggaaacttgatgaatataaagtggctaattagccactttatatttgcatctgatatttaaacaaatgttttaaagatgacattatccgctttctgaatataactattcatttgatcaaaattcatatagcgataggtatcgtctttatcttgttgcaaattttgaacaaaatctaaatattcagatggggtaggtaatttacctaacaatgcagaaacggctgataattctgccgaggcgagatacacatttgctccttgtcctaaacgatttgggaagtttctagttgatgttgaaactaccgtcgcaccatcggcaacacgagcttggtttcccatacaaagagaacaacccggtacttcaattcttaccccacttttaccataaatgctgtaataaccttcgtcactaagcaacttagcatccattttagtagggggagcaagccatagccttgttggaattgtaccgttaaagcgagctaataatttacctgctgcacggaaatgaccaatattcgtcatgcaagaaccgatgaatacttcatcaattttgtcgccctgaacttcagaaagtaaacgagcatcatcaggatcattcggggcacataaaataggctccttgatttcattgagatcaatttcaataacagccgcatattcggcatctttatccgcctctaatagttgaggattcattaaccaattttccattgctcgaatacggcgttcaagggtacggacgtcaccatagccttcggcaatcatatatttaagtagaacaatattagattgtaaatattcgataataggttctttagcaagtttaatcgtacaagcagctgcggagcgttcagcggaggcatcggacagttcaaatgcttgctctacctttaattgctccaagccttcgatttctaaaatacgacctgaaaaaatgttctttttacctttcttttctacggtaagcaatccttgtttaatcgcataataaggaatggcatgaaccaagtctcgtaatgtaatccctgcttgcatttcacctttaaaacgcactaaaacgctttcaggcatatccaaaggcattactccggttgccgccgcaaaagcgaccagtccggaacctgccgggaaagagatacctattggaaaacgggtatgagaatctccgccggttcctactgtgtcaggtaataacatacgatttaaccatgaatggataacgccatcgccaggacgtaaagatacgcctcctcgattcataataaaatcgggtaaggtatgatgagtaaccacatcaacaggttttggataggcggcagtatgacagaaagattgcatcactaaatcagccgaaaaacctaaacaagccaaatctttaagctcatctcgggtcataggtcctgtagtatcctgtgagccaacggaagtcattcgaggttcacaatattgtccgggacgaataccctctacaccgcaagctcgccccaccattttttgtgccaaagtgaaacctttttgattttgcaccgcactttgtggtttggcaaaaacatcgctttcaggcaatcctaatgcaactcttgctttgtgagttaagcctcgcccgataatcaatggaatacgtccaccggcacgaacttcgtctaataacacattagtttttaagctaaattcagctaaaatatcattactgtcatgacgacaaattttgccttcataaggataaacatcgatgacatcgcccatatttaaacggctgacatctacttcaattggcaatgatccggcatcttctagcgtattaaagaaaataggtgcaatttttccccctaacaccacaccgccggcacgtttattcggaatataaggaatatcttcccccataaaccataaaactgagttagtcgcagatttacgtgaagacccagttcccacaacatcgcctacataaaccaacggaaagcctttttgtttcagtgtttctaattgtttgattggaccaatattaccattatcatccggtttaatgccttctcgggcattttttaacatagcaagagcatgtaatggaatatcaggacgagaccaagcatcttgtgctggcgaaagatcatcagtattagtttcaccgctcaccttaaatacggttaaggttaatttttctgcaagttgagggcgagataaaaaccattcagcattagcccaagattgcaaaatctgttgtgcaaaaatgttaccgttttctgctcgttgtgcgacatcatgaaaattatcaaacatcagcaaagtagaagacaacgctttcactgctataggtgctaattcaggattatcaagtgcggtcaataatggctcaatattgtaaccaccttgcatagttcccaaaatttctactgctttgctgggtgaaattaatttacaagttaccgcactttgtgccagtgcggctaaaaaaccggctttaacataagcagcttcatcaacaccagcaggaatacgattctcaaataaatcaagtaggaaatcttcttttcctatcgggggatttttcaataattcaattaattgagctgtttgctctgcatctaaaggtttagggacgacgccttgtttagctcgttcatcgacatgtttttggtaagtttgtagaaaatcgcacattattcactccattaagattgttgagtagagaaaagagaaagtgcggtcatttttgttaaaaaattgtaatacaaatagaccgaattcatcataatacggaatttatagatgaacaatagaaaaaagacgattattaaaaaataaccgccttttttaaagtagaacacaaaatgtttaaaagacttttttaaatggtttaatgatgactttatcatatacaccggctgcaatataaggatctgtatttgcccattgctccgcttcttctaagctattgaattttgcaataacagttgaaccggtaaaacctgcttctccaggattttcatcatctatagcaggattaggtcccgcagttaataacctatcttcagcttgtaattgttttaaacgttcaaggtgttgttctctgacggataagcgtaatgctaatgtatcaggtttatcttgagcaaaaataacatagtacatcatggtttatttctcctatttattatgagttatttgctgaaatttgtgccaatgctttttctacttccggattattgtctcttggtatggctcgaggtttaccttgtgcatctacggcaacaaaagtgaaaacagcttccgttacacaatagcgttcaccaataggttcgctggcaacctttttgacccatacttcaattttgatttgaacggaagagcggccaatttttacacattccccataacagcaaaccacatcgccgacagcaataggtttgataaatgtcatactgtttacagctactgttacaacacgtccatgagcaatttctttagctaaaatggcaccgcctatatccatttttgacataatccaaccgccgaaaatatcgccattcgcattcgtatttgaaggcatagctaaggtacgtaataagagaactcccttcgattgacgacctgtattagtttcaataaatactgacatagattttccttattcttgttctgatttaggtaaataacgataaatataaacaccggttactaatgttgcaatcagtgtcatgccgagaatgccgaaggttttaaaatcaacccagatgtcatcagaaagatactggcttatgtaaagattaatcagcatacaaagtaagaaaaagactgcccaacctaaattgaggttatgccaaacataagtgggaagctgaatttctttgcctaataattgttggattaaaggttttttaaaaccatattggctgacaagcaaaatcaaggaaaaaagggcataaacaacggtaactttccattttaaaaattccaattcattaaaataggcacttagagaaccgaaaaaaactaccgcacttcccataataagttgctgtttctcaatttttccatatttaagttttaaaatcatgagttgaattaacgttgcaataatcagcgtaatggcagcggcttgaataccttgtaatttgtaaacagcaaagaataagatcaatgggataaattctaatagttgtttcattattgtcccctttgttgcataaagagagtgtaaaaacggtaagtgaaaattaatagaaatacctctgcaagggaaattattgcagtgattaagatttccataaacagattatgactgagaaatagcgaaagctgtcttaataaaaaaggcaataggcaattgattaaagtatataagaataacaggtgtgtgcgttttactccgcttttccacattgtttttaaactttgactaatggagtgattatgtatgaggtaatggacattgagtaaattaagacgcacaaacacaaatatacctaatgcgagtgcaaataaagaaaagatagaaggtgatttgtgcatgatagctgaaactagaatttcacttgtaccgatacccaaaggaatagctattaatatattgagtaacaaaagccctccgaaacgtttagttgtcgatataacgctttgagacagttgcggttcgatatgttgactgagttggtgaatggttaatattccccaagcagaaataaacattctcaataaacccgatatgaacaggtaatgactgagttgcaaagtttccgtatttgatattgtttctgatagctcaagcgtgtctgtttgtattgactgtttaaaaaataaagcaaatacagaaacaataaataaaagagcggtaaattgtagcgtgattttttgttgattgcgtacaaagttccaacaatcttgaaatatatgagtaaaattaatcattcaaaaatccataaataaaagcaaacgttacgcattatactgtgtttacagccgaaagtataaaaatccttattacagaccttaatcatactaaagaggagatttaaacttttagtaagctgattgtagcgattttaaaaaaatttttaacaaaattttataaatttgatctagttcacggaaataatacctcttaagtggtattgtacccgccgattgcataaatcggcaatttttattgtgagcaaatattctaatagatgaggaattttctatgaaaaaaacagcattagtacttagcgtggcggctgcattggtggcaggaagtgcaacagcacatgaagcaggcagttttattgttcggggtggtcctattttagttgtgccgaaaacatcaacaaatgatactacgtttaagtttgatgtaaacaaaaatgcccaattggggttaaccggaacctatatgatgacagataacttcggggttgagttattagctgcaacaccgtttcatcataaaattacattagaattacattaggtagtaccttagtaggtaaaacaaaacatttaccgccaagcctatatttacaatattatttcttaaacaaagattctaaagcacgtccttatattggtgccggtgtgaactatactaaattctttggtgaaaaagcgataatggcaaatgtttccaatcttaaattaaaagattcttggggagcagtatttaacgcaggggtagatattcaattgtccgataatctttatttaaataccgctgtttggtatgcgaaaattaaaacaaaagcaagttttaannnnnnnnnnnnnnnnnnnnnnnnncaacaacataaagtcgatgtaacccttgacccaatggtatttttcatcggtttaggttggaaattctaagcagagaaaaatattgttgaaggcatgaccaaaaggtgatgcctttatttttttctcaaaatgaccgcacttttatggaaatagcgtataaagtaaaaattaatgttttctctttacatgattttcgttagaattcggcattcgtccatttttagttattacaacaataatgatcaagcaagctcaattttatattctttctcaacaacaaggaaaaaacggactttttgcggaagaaagtcttgcttgcgatcttgccgcctccgcttggcggttggggaaaaaagtattaatcacttgtgaaacggaagagcaggcattaaaacttgatgaagctttatggcaaagagatcctgatgaatttgtaccgcacaatttatccggtgaaatgacttcatacgtaacgccgatagagatttcttggcaagggaaacgtaatacgcaacgacgggatatactgattaatctgcaatctcaattacctgattttattatgagttttaatcagctaattgattttgtgccagttgatgagcagttaaaaattcttgcgagagaacgctataaatcgcttcgttcgcaaggttggcaattacaaacagaaaatatgtaaatttttataaggagtttttttatgaaatctaaaattttggctaccacactcgttggattgctattcggattggttgcttgtgaaaaatcacaagaaagtgtatcaaccgaaaaaatggataacaagcagacggagcaagttgaacaaaaacaactggaaagtgcggtggaaaacagcactgaaacacctgtgcaacatgttcaaactgataagatgtcagaaggaatgaaatcaacaaccgaagaagctagcactgattcagcaataaaccaagaaaaattagctgaaaataaagttaaacaggttgaagctaaaaaagtagcggaaaaaaatgaaaccaaaaaagttattgcgattttagaaaaacaataccaaagccttcattgcaccgatggaaataaaagcgaattttgtgtagaagaagcacaacgcttaaaaagtgaaattgaacgactaaaatctcaattgcgtaaatagaaagatgagtagtcgttagatttaagacatctacgctagataatctcttctctctaggcggtaagttagaaaaataacaagccgtagaatggctaatttatgcccagcttcacacggtttctatggggaaagagcggttagattttcgggaaattttgcaaaaatgaatcgtaaattaatccaaatcgatcagctaaaaaatcagcttacacaatatcgtccgctttctgaatccgaagtaaagcgtctgcgagaagaatttattattgaaagctcatataattccaatgcgattgaaggcaataccattaccctgcgtgaaacagtgctgattttaaaagagggaatgacgattgcggaaaagtcattacgagaacatttggatattatcggttttaaagatgcttttaactatatttatgaattggtagcccataatgaaccgttaagcgagcgaaccattaaagatattcattcgcttgttttaatgaataatgccgaaagccgaggcgtttatcgtaaaattccggtgcgtattttaggggcggaaaacgaaccgacagctccttatttaattgctgaagaaatgcagtcattgattgaaaaatatcaacaaaaactgaccgcacttcaccccatagaagcaattagttggttgcatttagcctttgaaagtattcacccgtttattgacggcaacggacgcacagggcgattactgattaattttgaattattgaaacacggctatttacctgttgatattaaatttactcatcgagcaaactattaccaatgttttgatgatttccataaaaatcagcaggatataagtcgtttggttgaattgattagtcgatatgaattaacggaactggaaagatatttggcgattttggaacagaggacataaaatgacaagccgtgaagaattactcaaaaaacagcgtgagctagatattctttttaccgcttggtttgaagaaaagaaaaagcacgaagtgctgacttatcgtcgtgaaaatggggatttgattcagcattatccggacggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagagaaaaaccaatgacaaaacaattcacaatggaagatcgtttcaacccttccgccgtagagcaagcactctaccaacactgggaatcacaaggctattttaagccgaatgaaaacccgaatgttccaagttactgcatcgctattccgccaccgaatgtaacggggagtttgcatatgggacacgctttccagcagacattgatggataccttaatccgtttcaaccgtatggaaggtaacaacaccctttggcaggcggggactgaccacgcggggattgcgacccaaatggtggtggagcgtaaaatcgcagccgaagagggcaaaacccgccacgattatgggcgtgaagcctttatcaacaaaatctgggattggaaagcctattcgggcggtaccatcagccagcaaatgagacgctttggtaactcaatcgactgggatcgtgagcgttttacgatggacgaaggcttgtctaatgcggtgaaagaagtgtttgttcgcttacacgaagaaggcttgatttaccgtggcaaacgcctagtaaactgggatccgaaactgcacactgccatttccgatcttgaagttgaaaacaaagagagcaaaggctcgctttggcacttccgctatccgcttgctaacggtgcgaaaaccgctgagggcttagattatttagtggtggcgaccactcgtcctgaaacaatgttgggcgatacagcggttgcggttcaccccgaagatgagcgttatcaatcgctgattggcaaaacggtcgtgctaccgcttgccaaccgtgaaattccgattattgccgatgaatatgtggatcgtgagttcggtaccggcgtggtaaaaattacccctgcacatgactttaacgactacgaagtgggcaaacgccacgccttgccgatggtaaatgtgatgacgctcaatgccgatattcgtgcggaagcagaaattatcggcacagacggaaaaactctcgaaaattacaccgcacttattccacaggactatcaaggcttagagcgttttgtggctcgtaagaaaatcgtggctgattttgaggctctcggcttattagaccaaatcaaaccgcacgacttaaaagtcccttacggtgaccgtggtggcgtgccgattgagccgatgctgaccgatcaatggtatgtgagcgtgaaaccgcttgccgaagtcgccaccaaagcggtggaaaacggcgaaatccaattcgtacctaaacagtatgaaaatctttacttctcttggatgcgtgatattcaagattggtgtatttctcgtcaactttggtggggacatcgtattccggcttggtatgatgaacaaggcaatgtctatgttgctcgagatgaagcggaagtgcggtcaaaatacggcttaacttcagacgtagcgttaaaacaggatgaagacgtattagacacttggttctcgtccggattatggacattctcaacacttggctggcctgagcaaaccaaagaactgaaaatatttcacccgaccgatgtattaatcaccggttttgacatcatcttcttttgggtagcaagaatgattatgttcacgatgcacttcatcaaagatgaaaacggcaaaccgcaagtaccgtttaaaaccgtttatgtaacaggtttaattcgtgatgaacaagggcaaaaaatgtccaaatccaaagggaacgtgttagacccgattgatatgattgatggtatcagtcttgaggatttgcttgaaaaacgcaccggcaatatgatgcaaccacaattggcggaaaaaattgctaaagcaactcgtaaagaatttgaacatggcatttctgcacatggaacggatgcgttacgctttacccttgcggcgttagcgagcaatggacgtgatatcaattgggatatgaaacgtttggagggctaccgcaatttctgtaataaattatggaatgctagtcgttatgtattaacccacgaaaaattggatctaagtgagggcgaagcggaatattcgttggcggatcgttggattgagagtcaattcaaccgcactatagacgcatttcgcaccgcacttaagcaataccgtttcgatttagtggcaaatacgatttacgattttacttggaatcagttctgcgattggtatttagagctaaccaagcctgtatttgctcatggtacggatgctcaaaaacgtggtacaagtcgcatgcttctcaatatattagagaaattattgcgtttagcacatccaattattccatttatcacggaagaaatttggcagaaattgaagggtgtaatgaagttatcaggcgataccattatgttacaaccatttccacacgcagaggaaaatcggcttgatctagaggcggaaagccaaatgaattggttaaaagaagtgattgtagcggtgcgtaatattcgtgcggaatgcaatatttcaccgagtcatgcgttggaactgttgctgagaaacatttcagaggaaacaaaaatttgccttgaaaataaccgcactttattacaatctatggcaaaattgtctacgattactttactggacgtcaatgaagaaccgccactttcggtcacgaaactggttgaaaataatgaaatttttattccaatggcaggttttattaataaagagcaagaactcacaagattgactaaagaaattgaaaaattgaaaggtgaaattgttcgaattgaaaacaaactcagcaatgaagcctttattaccaaagcaccggagcaagttatcgctaaagagcgggaaaaaatgcaggggtatttggataatatagaaaaacttcaacagcaatatcaggcgattgagatgttgtaagtatttaggtcgatatttgatctcccgccgtcaaatggcggtcgggagatcgatgttaatcgtggtgaaaatctatcttaggttctcccaagaataacggaccgagtggatttttaggcaaattgaagtgattaggatacttcacctctaccaaatataaaccatcaggtttagcagttggtgcggctaaagtgcggtctttttgagttaaaagccaatccatccattcaaccggctgttttccgcttccaatttctaaaagactgccgacaatattgcgtaccatatgatgcacaaaagcgttagcttgaatatccacaataatgtaattggcttggcgaaaaacatggagatgatgaatatttcgccatggtgtattggactggcattgtgcggcacgaaatgaagaaaaatcatgttcccccaataaatactgtcctgcttggtgcattaaacgatgatccaatgcaacgtgatgatgagtaactccagtgggaaaaagagcggaacgtagcggatgattataaattaaataacgataacgccttgctgtggcactgaaacgagcatgaaaatcctcactgacgacctttgcccaacgtaccgcaatatcagcaggtaaattggcattaagaccgaatgtccatgctttttcagagcgaatcgctttcgtgtcaaaatgtaccacttgaccggtagcatgaacacccgaatccgttctacccgcacaatatatttgacaaaattcatttgcaacaaaactgaccgcactttccagtttttcctgtacacttgtgacattcgcttgacgttgccaaccgaaataatgtgtaccgttatattcaatacctaatgctattttcatattattttatctgttaagctgaaacccattttatgatacttgaatatagtcgagcggtatatcacctaaatacgccaatagttcttctgtcataccacgatatgacaacctgaaaggttgttcaaccaataccgctcgagcaatattttccacctcatttccatctaaaattaaataattcaatgctgtttgtagtggcggtaaagagggattaaatgcggcattttcagcataactgccttgaaaaatctgttgatcttgcaattgcaatgcaatacctgaataggttttggaataaggagcatgagattgattagcagcatcaagtgcggcttgaattaacggatcttccgttatcaaaaacaaattatgtgcttttttatcaaatagacgattatctatctgtaaattatggggtccaaaagcatccggcaaatagtgatgtaataaattatcctgactatgtggcaaatgaatgcgtaatgtttccgcactgttaagttcattcataaattggcgacaatgtccacaaggtgtgtaattgacggtaatctctgttattttactttcacgacgcatccaagcatgagaaattgcactttgctccgcatgaacggtttgctgaatgtttgtggtacaaaattcttgattagcaccaaaataaaagctgcctgactctcctttagcaattgcccccacactgaaatgggagattgtgggattagcataacacgcactgacgggtaataatattaaagccaattctttgtccgtcatatgatatttttcgcaaaaatggtttactgtgaatgcgggtagaaagccctgaaaattccgttcgcctaagatataccacagatcctgagctaattttctgttttcaatttgatttaaagcctgtttaatccgatcagatatatgttttaatgaatgatgtgtcatcataaatccttgttgaatattgagattgggttgaatgtgccaaacatttaaaataacgtcaagtagatgttttgattgtatcttattatttttggctgaaaaatttccaattataacaagttaaacacttttaatatttcatcaaaaatataattttctgcattgaaatagttactcttttttaaacgacatagcataactcgccataaaattggatctttaatttttacgctgactannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacctagtaatagttcaccttttaatgaatatgcaccttgttcttttacttcaaattcaatttgaggattatttataatcagttccggcaaaattttagaaaaaatcaaagataaaattaaaggtggaataccgatagatattcgccctgtcatttcttgttctttcttatgtagatttttgttcatttgattgtatttcttgagtaattctttagcatcacggtagtagttttctccaacgtaagttaaccctctaatttttccattagctcgtgtaaataatgcaatattttcttgatgctcaaattcattaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnataaaaaggtttatttcaagcaactaaaatagctatctgcggtatattgtaagaaattggcataggaatttttacctaatttaactttgtcacccatcggatccaagcgtccaacgtttacacctgttgctttacctaaactttcaattacttttggtgtaaattgcggttctgcgaataagcaatttactttatgctcagtaatttcttccttaattttagctaatgtttttgcccccggtgcaactaatggattaatagtgaaatagcctacttgatttaatccataagcgttattgaaatagctgtaagcatcatggaaaacataaaatcctttttcttttactgaagctaattgctttttaatttcgttattttttgctgctaaagtgcggttaaattcagcaagatttttttcaatcaatgcttttttggccggatattgtattgacaatttctctgctactttttgtgcaacaattttgctaatttccggtgagtaccaaacatgccaattaatgcccaattcatcatgttcatgattgtgtccatgcttgtgttcatggtcatgtttgtggtcgtgatcatgatcgtggtcatggtcgtggtcgtggtcatggtcgtggtcgtggtcgtggtcgtggtcatggtcatggtcatggtcgtggtcatggtcatggtcgtggtcgtgttcatggtcatgtttgtggtcgtgatcatgatcgtggtcatggtcgtggtcgtggtcatggtcgtggtcgtggtcgtggtcatggtcatggtcatggtcgtggtcatggtcatggtcgtgatcatgatgatggcctgtcattaaaagtcctttagtattaatttctgaaatttcagcaatggtaactacttttttcggatctataccacgtaaagttgcatgatctaaaaacgcatccacatcttcgccaatccaaacaactaaatctgctttttttagtttttgaatatcggaagggcggaaactatagtcgtgtggcgatgcacccggtggaacaataacttgggtatcagttacaccatcagcaatagatgaagcgataaaacctaaaggtttaattgatgttactatgctagcatttgccacagcagataaagaaaaaagtgctgtactaattaatgcttttttaaaggtaaaattagacattggaatactccttttcatgattaataacgattttaaaagacggactaggttatcactttttcatcaaattgctagaatttttacaaaaatttttagccttttgtcaatttatctacaacttttgccaccgcaaaaaaaccaaaagttgcggtaatcattgttgcagcaccaaagccattggcacaattcatggtagctgaagtagtacaattatcagccatttttggaaaaattaaaggctgagtggaaaaaacacaatcgactgcaaacttacgtttaggattttgtggaaaatgatattctttacgtaaaactgaccgcacttttgctaatagaggatcttgaatagagcgactaagatctgtcactcgaatttgacttggatcggtttgccctcctgcaccaccaattgtgataatcggaattttattgcgtttacagtgagcaattagtgctgcttttactctgacattgtcaatagcatcaatcacataatcgtagcctgtatgaatatattcagctaaattttcagcaagtaaaaaatcatcaataatattcacgtggcaatccggattaattaattgcacacgctctttcattacttctgtttttaacttaccaatattacctgttaatgcaggtaattggcggttaatattggttacacaaatatcgtccatatcaatcatggtaatttgcccaataccgcaacgtgcaattgcttcgacaccccatgaacctaccccaccaatgccgatcacacaaatatgtgtttgctttaagcgttccaaaacgtctattccatatagtcgtccaattccaccaaagcgttgttcataattatcaatacgttctgtcattattgtaataaccacactctaccatagtgcttcgataaacccgcaacatgtccggcattatcgccaattccacgatataaatcaaaatgttgcccttttactgctcccccaacatctaatgccaccattaaatgtaaaatatgttcaccggtccaattgccttcatcatcaattttcggtacttccactaaaactacagagccgcttgggatcacatttttatcgctagcaatagcagccataggtactaaaggcacaccggcagaaccaagcacttttccgttaggatcttttttgaaaaaaacataagaaggattacgttctaacaaggcttgtaagcgtgatggattttccattgcccaatttttaatggcttgaatagacattttttctttggaaatttcgccatcctctaccagcaatcgtcctattgctacataatcaaaaccattttgtcctgcataggcaaaataggttaaatctccgtgaccaaaatcaacataaccgctaccttgtacgccaagtagaaaattatcaatcattgaatcagtgtaagccagctcaagtcccttacctcgcaaggcaccggcataaatttgagctcgagaaaaacgtttattagcaggcaaagcataaataggttgattatatttgccctgttgcgtatgacgagcatgaataaccggcgaataatatcctgtcattaatacattttggtatccgtcggttcctttcataatttgagcttgaataccatagtctgctaattgtttagtattcgcaccagccaatacccaatgagttactttgtcataaatgttcgcaaattgattagctaagccagttgatgcttgacgaatattagtaagttgcgttaaaaaatcaccttgattgatgaccgcacttttgttgtcaacagaggaaaccggcactaatgacgcttgctgataactacgcccagcatattttgccccgaattgtttcgcatcattttggctagctgttttagagtgttcggaagaacatgcaaccaaaatagcgaccgaaaataaaatactttgtttaactactgttttgataaaaaataccatatgttaccgaaaaaccgcataattagagacgtcttaaattagcaaaaaaactgtagaatatacagtcttttatcattcaatgaagataaaaaatttacaattcgcttcattttatcattggttgttttgttatttacactgatgcaaaatgtttttacgcttgaattgtcaaataaaagtgcggtgttaatttagactactttgagtattgcaacgtcagggcttgattttgcagtccaagccctcaaaatcatttaaaactcaccgcacttttaggcttcatcaattccccaaagccaagccgccccacgcacaccactggaatcgccgtgtacggcttttttgatttcagtaaaaaattctctaccgaaaatataatcgttcatccgtgtcggtaaggttgtgtacagacgatcaatgttacaaacaccgcccgccagtacaatcacatcaggatctaaaatatttacataagctgctagagcttttgccaaacggcgttcataagcttgtaaagattgttcggcagtaggatcgccttgctcggcaagtgcggcaatttcgttgccttttaatcttatcccactccgacgttcgtaatcatcacatagaccggtaccggaaacaaattgttcgatacaacgatgtttgccacaataacattgtacgttatgcgaacgttcttcttcatcttgccaaggtaattcgttgtgtccccattcaccgccgataccgttagccccattccagggttttccgtcaatcacgataccggaaccgcaacctgttccgagaataagtgccaatacgaccttttttcctgctcctgcaccatctgtggcttcagagacggtcatgcagttggcatcattggcaattcttacttctcgtcctaaaagtgcggtcaagtcttcgtctaaattttgtccgttaagccaaacagaattagcatttttgactttgccggtaaaaggggaaatagtgccgggaattccgatccctactgtgcctcgttgccccgttgcatgttccgcatcatctaccaaacttttaattgctgtcaacgtgtccggatacgaccctctcggggtaggaatacgtttgcgaaacaactcttcaccgctgttacttaacgcaataacttcaatcttggttccacctaaatcaatacctatacgcataaaaaactcctataaatgaaatatgaatattgtgatccttgtaacattattttattttgatattttatatactttcctcctttaaaattattatcaggtattaatgtccaccagcatatcaattttagtcattgatgacgatattcaaatttgcgagctactcaccgatacttttgaagaatatgggtatagggttgttgcagtctcttccggtcaggaagcattaaccttattacaaaccaattctcgctttgatttgattttattagaccttattctccccgatattaacggactggttttgcttcaacaattaaaaaatctgttgaataagcccatcattatgttgagtggcttaaatagcgaatccgatgtagttgttggtttggaaatgggggctgatgattatattaccaagcctttttatcctcgaattgtagtggcgagagctaaagctgctattcgtcgcactcaaccacaagccacaaccaccgtttatacgcatagcggttttttgtttcatcaatggtatttagataccgaaacacataaactttattcgccccaaaaacaggaaattgaactgactcacggcgaatatttattattgtatgccttagtttctcacgctcaaaaagtgttgagccgtcaaaaattattagaattaacccatgcagaaaatttggaaatttttgaccgcactattgatgtattaattatgcgactacgtaaaaaaattgaaccgaatgttaaggctccgagttttattcagactgttcgaggcctagggtattgctttgaggcttcagttgaaaaactgggagaaaattaagtacgctattatgcaactcaaatcctcactttttaagtattctgcattgtttctttggtacgaataaaatcctttaatttcacatagctgactgcaccttcagtagcagagagtgaaaataaattgaaatacgccaaaccgtgtcctaattgtaaggttttttgtaacggtaaattctgatgtaatccgtataaaataccactacagaaagcatctccagcccccaatgtactcagaattttatctttttcgacccagtaggaaggaaccgtaacaatatttcccagcaaatcacaagcaaccgcatatttaggtgaatgtacaataacggctttctttacacccagttgcataatcgcttttgccgtcgtaaccaactctttttctgtagaagctatatttacttgttccgttaaaattttggcttccacatcattaataatcacaaagtccacataggataagatcgggcgaataacatttttaaaaatctgtttattttcacaggaaaccaaatcaatcgaaataagaaaacccttttcttttagcactgtcaatgtttttaccagttttgagacatccagcaacgccggcagtaagggcaaataagcgatatgggcaattttagcattacaatctatcgaggtaacagtttgatgatcatattgctgcattgctcctatgtaatgaaaaaaagtccgctctccgttttgactgttaatcattacatcagtaaaggaagtggggagatcgctttctaacattgcggttaataccacattgtgtttcttagcttgccgtaaaataaattgtccttcactatcttttccaatagcaccacttaaaaataaagagagctcgggatccaatttagataaattgaataacacattagtacagccacccccacagtgtaatcccatttccgaaatagttgccaacatcgtttctttgggataatcggagatcactaaagttcgatctaccaataagtttcccaacgccaaaatacccttacgtttttgcataatatctagctttatcgatgctgttaaaaattttcaattgttcggcaacggtttgactaatcgcatgttgcatattattcattatcatcaagtattgattatatttgccacttaattctatggatctcatatccaccgctaaggtatctaatgccgtttgagacatgccggtaaagaaattgattttgcaaatacccaattcaatagttttacggaaatcttctgcactaattcctgaaccaccatgtaataccaaaggaacatcaacagcttgattgatttgtgcaaggcgttcaaaatcaagcttaggttcgcctttatatttcccgtgcgtattaccaatcgcaactgctagagtatcaataccggttttttctacaaattccttggcttgttccactttggtataaagtgctacatctgctatactttctaacgcaccgccttcatcgccacccacggcacctaattcaccttccacagaaatattataagggcgacataattccactatttctctagtttgacgaatattttcttcataagataaagaagaaccatcaaacataatagaggagaagccacattcaatggcttgtttgacggttggtaaagttaaaccatgatcgaggtttaaacaaactgggatacttgctaattgagctttctttttaatgtatttggcggtcgcaggtaaatcgatatattgcaaatgtacttccgcgacattaataatcaccggtgattgctgctgtttagccgcagcaaatactgcatcaataaaattggaatcaattgcattaaatgctcccacggcaaatttatgttgtaccgcaacggtcagcatttcttttaaattaattaacgacataaaaattccttataatcactacaaagtaaacggataggttgttcattttcctgaatggttgaaaaacgtccaagagattctaaaaaacggttatcggtgagatcatcatttgtcattgatacctcaccaactaaaacatcgctatcttccgcccaaaagctgtggtagagcattggtggtaagcaaatactttggcctgggctaagacgaattttgctacctgcggcaacttgatattgttccccgtctatttgaatatcaatggacgaaaccttatctagcagctccgttatttcatcacgcctgtataactgaatgactaaaatgccaccgccacgatttataatatcttccatttttttccaatggtagtgcattggcgtaatttggttttgcttcaccaacataattttttcggcataaggtttattgtttctatccgactgattacgcaaggtaaatagggtcaatcccgcctgtttgaaattacctaaattaaaatccgtcacatcccagcccaaatttgcttctagtatttcagcatagcgttccaaagaaagtgtatgccaatccgctagtgaaaaatccgcaaatttcggcagtacaaagtggtattttgccatcatttgctgtgcttctctgatcgcttgattaatttccgaacgcttcatattttatttcctgtcatcaaaacaatgaaaaaatctaccgcactttttagctgttgataatatgttaaagccgttgcacaaagggaacggcttggtttttctataattattttacagtccaacctttgtaatctttgatgttatcgcgattaattaaggttacaggaatcaagaccggtttttctggtgcggctttaccttgtaaaatatcgtaaccgatttctaccgctttcgctgccataacttgcggatcttgtgccggtgtgccgttaaacaagctattgctttgttttaatgcatcttcaccgtctggagaaccatctacacccatgataaaaaattctttacgttgtgcctgtttcgccgctaagtcggcaccgattgctgtcggatcattaattgcaaatactgcatcaattttcgggtgagcgattaataaggaagtcattacttctaaaccaccttcacgactgccttttgcattttgattgtgagacaataatttgatccctttatgcttagccaatacatccatacaaccttgaacacggtcttgtaccgcagaaactggtggaccgttgatgataaccacattacctttaccatttaatttatcggtaatggtttgacatgcaatttcacccgcttggtagttattggaagtgacggttgcatttgcaccatctgccgctacatctactgccacaacaacgattccggcttttttcgcacgctctactgcaggtcctatacctttagaatctgcagcatttaaaatgatcatatcggttttcgctgcaatgaagttgtcaatttgtgctacttgttgacctaaatcgtagccactggacacggatgtcacattcactttatcgccagccagttcttttgcttttaactcagcacctttggcaatttgcacgaaaaaaggattggccaaatcaccgactgttacaccgatagatttaagttctttggcttgagccaaaggagccatggccaacataacacttactgctaatgtttttaatttcataaaatatctcctatgagattatggttaaggaaaagtttgagtaatttacccaaattagtttgctttactggtacgatacttatcgatgagtactgctacgataattacgccacctttaatgacaagttgccagaaataagatacccccattaatgtcataccgttattgagagttgcaatgatcaatgcaccgattaatgtgcctgtaattgtaccgataccgccaacgaaactggttccgcctaaaataaccgcagcaatagcatctaattcatagccaacccctaagttaccgttagcactatataaacgagaagcactcatcacaccacccaaaccggataataaaccgctggtagcatacacaaaaatcaacactagagatactttgataccagttaaatgggcagcctgtaaattcccaccaaccgcataaatatgtgtacctaacgttgtgcgacgtaaaataaaccaacataccgcaattactgcaaaggcaataatgactaaccaaggaatagagcctagataaccgttaccgatccagtcaaaagaaatttttgagttaatcactgttgtgccgtcagccactaagtaagcagcaccacgaagtgcggtataagttccaagcgttacaataaatggtggcaatcctgcataagcaaccaataaaccattaaaaacacccatacctaaacctgcaactagagcaatcggtactgcaaaatcggcaagtgcaggatttaacgaacacaccaatgccatgacggcagttactcctaaaattgaccctacggataaatcaattccaccggttaaaatgatgaaagtcattcctgctgccaagacgatattaattgatgcctgacgggcaatattcatcatattggcttcactcataaaattgggggcaataaaggaaaagacgataataatcagtagcaagataggtaaaatacccattgcttggaacatatccgataatgcctgttttttagctcctgattttgctacattttccatattaagctccttacatctaaatttacgctgcaccacaggccaatgccataatgctttcttgattaatttgttcacctagaacttcaccgacaacatagccttcccgcattacataaacacgatcgctcataccgacaatttcaggtaattcactggaaatcattaaaatcgctacaccttgttttgccatttcaatcatcattttataaatctcactttttgcaccaacatccacacctcgtgtcggttcatctaaaatgaataacttcggatgaattcccatccaacgggacaacaatactttttgttgattaccgccggatagtccactcacatcgacattagcattcggcactcggatttttaaacttttaattgcctgatcagtatccgcttttccttttgtctgattaatcaccatcatggtggcatcacgttcaatggtcgcaatagttatgtttttaaatacgttcatatcaaggaataatccttcttctttacgattttccggtaataatgctacgtgatgaataatggcttctcgaggtgagctgaaactaatttcggcaccgtttaaatacattttgccttgtgtaggtcgactaacaccaaataataaatgagctaattcagaacgacctgcaccaaccaaaccggataagccaataatttcacctgctcttacaaccaaagaagcattttttattttattaccgtcagaaagattttcaatgcgaatgacttcctcgcctattggtactttttctttattaaacaaatctgttagtggtcgtcctaccatcatttgtactaaagtgttggcatgcaaattctcacgtagtaaagatccaacatactttccgtcacgtaatacactcacacgatccgccaattcgtaaatttccgccattcggtgactaatatagataattgccaatccttccgaccgtaattttttgatcaactcaaacaatttttctgtttcacgggaggataatgcagcagtcggctcatccatcactaaaattcgacttttacgatgtaacgcgcgggcaatttctacttgctgttgctcagcaatggtgagagaggacactttttgataggcgaaaaattgagcacctaaacggtctaatacttcctgtgcttcttcttccattttcttgcgattcaagccaaataccgtaccgatttcacgacctaaaaaaatattttctgcaactgtcaaattcggtgaaagatgaatttcttgataaattaaagtaattcccgcaagaatggcatctttcggcgaagaaatcggaaagagtttgccgtcaatgttgatttcaccggaagtagcaatatacgcacctgccaaaattttcattaatgtacttttaccggcaccattttcacccattaacgcatgaatttcaccacgatatacatctaaatcaacatgttgcaatgcataaaaatcgccgaaacgtttggcgatatgacgcatttccaacaacggtgttacggaaatattgacagcctgctccattttaattgccctcaatctttattttgatttacagtaaagcataagtttatgaacagaacatgttaaaaactcattcatatttgtcataattccataatagaaactatttataatgtcacactcggtcaaaagtgcggtaaaaattacaaaagttttattcagtcggtagttatatgttaaaaaaacttttttctactcattcctacggtgttagattacgattgatcgtattcgtactggtggcagtttttctgattttttcaattagtgtgatgtctgtatttggattgaattccagtcataacgccctgtcaaatttacgtgatcgctccatgaaccaaatgtttttctccatgagtttaggtatcaaaaccactcagatttccacttatgccaataaactcaggcagacctttcgtgcattagaatatcaggaagcgtccaagcaactggcacagcatattgagcaagtacatcattatttggatcaaggcaaaaaatacgccagtccgttagagcaacatcaattttcagggattattcaatctattgacttattggaaaaaagtgtgcaagagctgttacaacaagcctatcaacgccatgttttgaataccagcatcatcagcaaattaaaccaatccttactttatttagaacacattaaaaggttagaaaaacgcaccgcacttttagcagacggcaaactgtttgtttctgactttcaacaaattgaaaacttgattgaaactgcgactaaaggtttattttcacctgaaacctttattgccattcgctcagtattttcatttttacccgagaaaaaacagccagatattcagcaagaatggataaaaatagaaaatgaatttgaacttatcactaaatcagcctaccaattggtagcgattaatcaacgtattcaattcttaacttatcaaattgattcgcttgtagctcaaattgaccgagattacagccgtttggcacaagaaaaaatcgctattgtgaatagtgaatctgcaaaaattcaaaccgcactttccaagcatattttgtatatttggggagcttctttattcacagtcggcttgattatcattttgggtatttatatttatcgcttattcggtaagcgtttgtattctattactcaggcgatgactcgcttatcacaaggggataaatatgctcaagtaccgcaacaacaacgacaagatgaaatcggcgaattagctcgagctttttatatttttcagcaaaatgtggtgaaactagcacgtaccgatgccttattgaaagaaaaaagtgaattgttggagcgaacttttttggcaatgcgggacggtttggcgatttttaatccctccggttgtttaatgtcttgcaatagccaatttatacaattattacattggcatgaagagcaagcacgagaggctaatttttcaagtctagcgttctttttacagcaaggttcagcaaaaatttatggtagctcggagcaaattaatgaaaaattattaagtgaaatgcgtagtgagcaagaaccattggaaatcgactattgccggcaaattttggaatggagggtaagtgccttacaagacggtggtttggtggcgtttttaattgatcgtactcaacgtaaaaaattggaaacggatttagcacacagtcaaaaaatgcgaagtatcggtcatttaaccggtggaattgctcacgatttcaataatttattggcggtgattattggtaatttagatttgatagatcctgaaactttacacgacaaacaggcaaaacgtttgcaacgtgcattaaaagcggcagaaaatagtgcaacattaacacagcgtttgctggcttatgcccgcaagcaacctctccatccgacctcattagatttaaaccagctattatttgaattttccgattttatgaaacatagcctgccagcaacgattacagtgcggttagatttagcggagaatttaccgctgatttatatggataaaaatcaattggaaacagccttggtgaatttattggtgaatgccaaagatgccttagagagtaaaggcgaaattgtgctgaaaacccgtcaattattagtccaacgaacccataaaaccgaacaaatggtgcaactgtcaattattgataacggttgcggaatgagtgaagaaactcgtcgccatatttttgaacctttttttaccaccaaacaaaacggtaaaggtagcggtttgggattgtcgatggtatatggatttattcgccaatctaaaggaagggttaaagtacaatccgaactgggtaaaggcactaagatccatttacagctacctatttcccgcagaaattcaacaatttccaccgcacttccagcgagtatggatttatctgaacgagcgacattaatacttatcgaagatcaaaaagatcttcgggaaaccttaaatgaacaacttatcgcaatgggctatcaaactctcgtatttgaaaatgcggaacaagcaatgtcgcatttatcgaaaaacgaacgcatagaatatgaatatctgttatccgatgtggttttgaacggcaaaatgagcggtattgatttagcaaattatataaaataccgttttcccttaatcaaaatactgctaatgacagggaaccatacggaatacatcgctcagttcagtgagtttgaggtgttaaataagcctttcaaacaagaagaattattggttcgtttgaaatctttatgataaagaagactgtagcaaattcctgtaattaaagtgcggttgaaagtttttctattttaaccgcactgagtttaagcataaatacagttattgactaaattttatgttatacatcgtaaatatgcttaatcagactcacaaagaatttagaaaatcttgttttatttttgtgatcttcatcacaattttatggtttgaatttataaattgtgataaatatcacgtttttatcactgattaaataataaaaaatgtgtcctacatcacaaatcttaaagaaaaaatttttgcttttattataaatatgttattttttctgcctgaaaaatagccaattatttctctttacgtgttctatttattgaggttaagttatgctatcagcaaatgcaaaagtcaaaatccaaagtgttggacgtttcttatcaaatatggtgatgcctaacattggggcatttattgcgtggggttttatcaccgcactttttattccgacagggtggttgccaaatgaaatcttggcgaagttagtcggaccaatgataatgtacttactgccattattaatcggttatactggcggtaaattagttggtggagagcgtggtgcagtagtcggggcgattactactgccggtgtgatcgtcggtacagatattccaatgttccttggtgcaatgatcgcaggtccaaccggcggctgggcaattaaacgttttgacaaatgggctgatggcaaaatcaaaagcggttttgagatgttagtcaataacttctcttccggtattattggaatgattttagccattctattcttctggatcatcggaccggctgtaaaagtagtttccggttggttggctagcggtgtagatgtacttgttcaagcaggcttattgccactcacctcaatttttgtcgaacctgcaaaaatcttgtttttaaacaatgcaattaaccatggtattttttcaccgttaggtatccaacaatcacaagaattaggtcaatctgttttcttcctaattgaagcgaaccccggtcctggcttgggcgtgttgttagcttatatgttattcggtaaagggtctgccaaacaaacttccggcggtgctgctgtaattcacttctttggaggtattcacgaaatttattttccttatgtgttaatgaacccacgtttattaattgcagtgattgcaggtggtgcaacaggcgtatttacattggtattatttaatgcaggcttacaagcaccagcatctccgggggcaattattgccgtgttagctatgacaccgaaaacctctttcatcggtgtgattttatctgttatcgcctcttgtaccgtatctttcgtcatttcttctttcttcttgaaaatttcaaaagaagaaagcaaaaataccctagaagaaatgcaagcagcttctaaagcaatgaaaggtggtaatacagcaacgaaaagtgcggtgatagatttgaacgaggtgaaaaaaatctttgtttcttgcgatgccggtatggggtctagtgcaatgggtgccggaatgttacgtaaaaaagtaaaagatgctggcttgacaattgatgtaactaactgtgcgattaatgatttaccggaagatgcccgtttagttattactcatcaagatttaaccttgcgtgcgaaaaaacaagttccgaatgcaatacatttgtcattacaaaacttcttagataacaaattctacgacagtttagtgcttgatttgcaagctgcaacaaaagatactgtagtaccgatagcggaagaaaatgcgattgacgtcaagggtacaacatttactcttaacgcagagcaaattttcttgggcttgaatgcagacagcaaagcggatgcaattcgtttcgccggtgagcaattggtgaaatttggtttcgtgcaaccaagctatattgatgcaatgtttgctcgtgaagaattagtttctacttatttaggtgaaggtttagccgtgccacacggaacagcagaagcaaaagatgcggtgttgaaaaccggtattgtagtgtgccaatatccacaaggcgttcgttttaccgacgaagaagacggcgtagcgaaattagtaatcgggattgcggcgaaaggcaatgagcatattcaagtactaaccgcaattactaacgcattggatagcgaagaagccattacaacactaacatcaactgatgatatagaaaaagtgctgaccttattgaaagcttaaaagtgcggtaaaaaatggcgtagttttgactacgccatctttgtttataattttattgattgggagagcaaaatgaacgcattacatttcggagcaggtaatatcggtcgtggttttatcggcaaagtattagctgatagcggagttcaagtaacctttgccgatgtgaatgaacaggtaattgatctattgaaaagacatcagtcttataacgtgaaaatcgttggcgacagcattaatgcgatggaaagcgtacgtcatgttacgggggtggattcaaaagacacaaatgctttgattgagctgtttaaaacggttgatttagttaccactgctgttggtcctaccgtgttaaaaattatttctagcactatcgccaaaggtattgaagctcgtttaaccgcaggcaattttaagccgttaaacattatcgcttgtgaaaatatggttcgtggaacgacctttttaaaagagcaggttttcacacatcttacagaggaattgcaagcagacgctgaaaaatatgtaggtttcgttgatagtgcggtagatcgcattgtgccacctgtgcaagaagatatatcggatcctttgttggtaacagtagaggaattttgtgaatggatcgtagatagcacccaattcaaaggtgatattccaaacattcaaggaatggaattaactgataatttgatggcatttgtagagcgtaaattattcaccttgaatacaggacacgctgtgaccgcctatttcggcaaacgcaaaggctatcaattcgtgaaagaaagcattgaagatcccgacatcaaagagtttgtagcggctgtcatgcaagaaagcggtgcagtgttaattcagcgttacggttttgaaccgcaagcacatgccgcttatattgaaaaaattctcaagcgttttgctaatccatatttagtagataatgtggaacgtgtgggtcgccagcccttacgcaaattaagctacaatgatcgcttaatcaaaccattgcgtggtactattgaatacaatttagctaatcagcatctaattcgtgcaatagcttacgcactgactttccgttgtgaagatgatccgcaagcagtagaattagcacaatctttggcagaaatcggtgtaacagaaacgttgaaaaaatacacggaattgcaagatgtcgttattattgagcaaatagctcaagcctataatgaagtaaataaatcttagacaaaagagcggtcagtttgcaaaacttcctaaaaaatgaccgctctttctctttcaagcataggaaaaacaagttgttatctgaagatcctatttatgaaaaattaaacggtaccgtttccgtgcgaggttttatgattgctactgtggcaatttttgaagaggcggtagatagtctgatcaatcgagtatttcgaaaaacagattttgtggtacagtcggtgattgactctctttttaccaacgatggtcctcttggtgatctcagtgtacgtctcaaagtgttactcggacttggcgtgatccaacacaatctattttccgacgtaaatgcctttattcaatttaaggaaacattaaataaggacgaaaaggaatacactttcgatgatgaaattgtactcacttttttgcaaaaattaacgctgttgatggataaatcagcacttgattttgagccattaatcgaagacaaaaacagccttacttaccagatgaaatctctgcgacgggaaaaaattattcgttcttgtttaatattgaccattgcagatatttaccgtcaattacaaatcgaaagtccattttgatcatttaaataaattggtacacaacacaaaggtaagcattgattttacagctaaaaacgcatcttaaaaaacaggtaaacaggtagtataagatgtctataatgaattttttagctgtaatttttccagtaatttctgatgaattcccccaaaactaccatttgacatgaccaaaatatgatcttcaggttgtgcctcagtaacaattaaatcaactaagttgtccagatttccagaccattttgccggttgcacacaatcattagtaatttcaactacattccaaggaatattttccggttgcaataaaaaaacataatccgctcttgccaatgccggtgctatttcatctttatgaattcccattttcatcgtatttgagcgaggttcaagcactgccaaaatacgtgctccgccaccgaccttgtctcgaagtgcggttaatgttgcaagaatttctgccggatgatgggcaaagtcgtcataaacagtaactccatttacttcaccttttacttccaaacgacgtttcgcattaacaaaagaatatagtgcttgacaagcatccttgacttgcacgcccacatggtaagctgccgcaatcgccataagtgcattattcatattatgttgaccgacgatattccattgcacttcaccggctttttttccctgatgataaacagcaaaatgcgaactgtcatgagctattctttccgtatgccattcctgatcttgtcccaaaaaatgcatttcagaccagcaacccatgtctagagtttcttttacagattgttcatgagcaaaggcaagaatacgaccgctcttaggcattgttctaatcatatggtgaaactggcgttgaatcgcttgtaggttgtcaaaaatatccgcatgatcaaaccctaagttattgataataagcgtttttggattgtaatgtacaaatttggaacgtttatcaaaaaatgccgtatcgtattcgtcagcttctataacaaaaaatggactcttgcctaagcgtgctgaaacaccgaaattgccggctattccacctattaagaatcccggctgcaagccattttgttctaaaatccaacttaacataccggttgttgttgttttgccgtgtgttcccgatacggcaagcacccagcgatcacgtaataaatgctcgtgtaaccattgtggacctgaacgataaggtaagctattttccaacacatactctatgcaaggattaccacgtttcattgcattgccaatgacgactaaatcaggtgctggttgcaactgcgaaacgtcaaagtgcggtatgatttcaataccattttgttgtaaaaaagtactcatcggagggtaaatattcgtgtctgaccctgtgattttatagcccatttgtttggcaataatagctactccccccatgaaagtgccacagatacccaaaatatgaatatgcttattgttcatttatttctattccccaaaatgtataaaaaatgtgttatagatcacattgtgagaaatcaattcattcgttaaaaagtgaaggttgttataataaagcaactccaactgagagtaaatttaaattatggaaggattaaattatgaaaacattaggacaatttattgtagaaaaacaagcagaatatcccaacgctaaaggagagctgtcagggattctatcttccttgcgtttagttgccaaaatcattcatcgtgatataaataaggcaggactaaccaacaatattattggtaattccggcgttgaaaatgtacaaggggaaacgcaaatgaagttagatttgtttgcacataatacaatgaagcaggccttgattactcgtgaggaagtggcaggatttgcctccgaagaagaagaaaattttgttgcctttgatactgaacgtggtcgcaatgcaaaatatgtcattcttaccgatcctttggatggttcctcaaatattgatgtcaatgtggctgtcggtacaattttttcaatttatcgccgtgtttctcccattggtacacctgttaccttagaagattttttacagccaggacataaacaagttgccgccggttatattgtatatggttcatcgacaatgttggtttatactacaggcaacggtgtaaacggctttacttatgacccctctttaggcgtattttgtttatctcatgaaaatatccaaataccgccaaacggtaaaatctactccattaatgaaggacagtatttgaagttcccaatgggggttaaaaaatatattaaatattgtcaagaaaaagataagtctactgaccgcccttacacttcacgttatatcggctcgcttgtttctgactttcaccgcaatatgcttaaaggcggaatttatatttacccgagtgcaacgacttatcctaaaggaaaattacgcttattatatgaaggtaatccgatggcttttcttgctgaacaggcaggtgggatcgcaagcgatggcaaagatcggattttagatattcaaccgaaagaattacacgaaagagtaccgctctttgtcggctcaagagaaatggtcagaaaagccgaagaatttatgcgtgaattttctgaagaataaccatttgaaaagacactgttttgtgtcataaaaaatctgcaccttaatcagttgattatctagttcaacttttgaggtgcagattaacatgtatatcggttttgagccttacttgacagaaattagaatttataatttacatttaaaacaaatgtgcgtcctcttgaatagttatttaaggttttctggtacccatcgcccacaccaaaaataaaggtcatttggcttgcagaatcattattcgcatctaatgggctaatatatcttttatcaaagacattttgaatttcgcctttaatggttaaattttctgtcggttgatagatggcataaagatcaaaaatcaccggttgtgctttgatttcttctgtaccggcaatccgcacataagtaaggtatactttgccatctttagatttgaacgtccccggtaagataacatcgccatctactttatcaactttagctcgtttacttttaccgtagtatttggcaatgccgcctaatgttaattttccgtcaaataaacgtgttcctaagtcaagggaaccgtaatctttcggtagagacgatattttacttaatccgaacccttgtaaatattttccactgctactaccgtcatttacagcactactggaatcggaatatgaacttggctgattggttttttgtctggcataggataaattggcatagaaccaaccgatatcataatttaattcaaattctattccttgcattttaacaataggcgatgaagcaacaggaatgatctccgcttccgtaccgccggtaaactcttgtggcttaaaaataccgccagtttgtgctggtgctgtagaactaagtttattttccgcttttttatagattgttttacccccttcgtagttaatatgggtaatatgtgcaacgcagtcatcaacggatacaggtttatcttttcctctatagctattcgagctacattcctgtttgacatttaaaatataatctctgattttcgtttgatacgccaagattttaaagcccagtacgtcgaaatccgaaaatacgccatttttataaccgttaatcccgaattgaatcgttttggctttttccgattttaaatcggttctcaccgctaaatcgccgatttcagagaaatacatttctttaatattcggtacacgatgggttttggcataactgacaaatggcgaaaagagcgggtgaaaatccgcagagaatgaagctgaataattatcatgtgatcttgaaccgcctttttctagggtatattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctactccgccgaaaaacctgcccattgtatttataaatttggcgattggcatttaattttaaggtataaatatcgtatttaaaggtttggtcaaaatagagggttttaaaacgttgttcgccatcgggttggaaagtattggattttgtgctgtgataaaaacaaggaagataacccggttcacctctattagggcaataatataaattcggagcaaaagttggctcaccatcctcaaaattataggctagttcacttggatggcgatttttactgtatttatttttgaggatattggcacctaatgttgcttcataagagaatttttctgttatcggaatagaaaaatgcatatttatatccatggtttttgcactatttttgctttccaacatatctttcagctttttgccattaaatacgcttcccttgtgataggtttgcgtagaggtattatctgccaagattaattcaaattgtaaattctctttcgggtttaattggtagtttaactggtagtttttattctctaaatttctgccggaaagtgcggtcgataaagtgcggtatgaaagaatggctttattatatttatcattatattcaattttggctaaatggcttttgggataatggagtaatttattcggatcatagggttgacgattgtacttttctattgcttctagagtacaactatctatccaaaatccccctttacaactttctcgtgccagtctcggtaaattatcttctctatctacatctacaatattcgttccaccacctactttaaaattttgcgagcttttacgccaactatacgcatacataaaacctaatgttcttgtatcggaaaaaggatagcgaaaagcaaccgcacccatataattaggccctatagcgtttgtaccccccccgcattcaataaaatacccgctctattaccttcacttatcacatcatcaacaccaattgttctaaagttagcagaaccaattaacccatttacaccaccttttccactaataccacctcgttgaatatctacactggtaataaacgcagggtcaatggttgcaccgaattgagaggttccaccggatttttcgctgttatctcccgatgtggcaaaaaaggtttgggaaataccgtccaccattgtattcacccgtccaaatcccgtttgaccacgaacgttcaccgacactgtccccgaacttttatcaaggttggtaaacgcacccggtaccgttctgatgatgtcatcaatagattgcgttgacgtggaaatattttctcttacactggttgcccccgcttttttaaagacttcctgtttaggtggcagtttatattctacattaatttgatcgagcatttcttccgcataaacacaagtgcttaatacggaaaacgctaccgcagtgagtttaaatttattagacataattttcctacttatgtatggttaaaaagattggtaaaaaagtagggcagttatataaaaatatcccgcgcatgtcaattaatgataataatttctattattattttattcccaagaatatgtaaagcctactgtgccattgcatttttatacaccaaatctgtaacgccaaacacaacggcactgtttcccgacttaatgtccgcactggcagtgtctgccgaggcatctaatttagaatcggaagcgactaataaaatagtcgatgcattaggtgctatttaattgcattttaccggtcgagtagcaacgttccatttgattttaaagatggtattcatagtgggattccttgtgtgaaagataaaaaataagacctagttctcatatgccaagaactaagccttatcgaagaaatgaataaaaaagaggtgtattcgttagttaaaaacgaatacaatcgtgctgtgctgtcatcatagattatgaatttcttgcgtcattcttcaaaccgtctggttgtataaaaaataaatctttttgtctaactctaacaaagaaataaaaatacatttatactgaaaattttaatttctttgttttcattgcataatagtaaaaatctcatagatggaaggaaaaaataatgaaaaatatgttactgatgagcagttctaaatacaaagataccggttacttaattcatacactaccttggttggatcaatttttgatggcatataaaggtaaaaagctcgcctttatcccttatgccggcgttactcgttcttttgatgaatacgaaatagcggtgcaacaagctttatcttgtttaggcatggaaattatctccgttcatcacggcaaaaaacatgcggatattattgagcaagccgatgtgatcggtattggtgggggtaatacgttttgcttattacaacggatgtatgaatataatgtcatgaatattattcgggagaaagtaaataacgggacaccttattttggttggagtgcaggggcaaacgtagcaggtagttcaattatgacaactaatgatatgccgattatttatccaccatcttttactgcgttaaatctatttccacatcaaatcaatcctcattttatttcaagcaaaattcaagggcataatggagaaagtcgtgaggatcgattaaaagaatttttaatcatcaatccgaccgcacttgtatatgcgttgcctgaaggtactgcgttgcatgttcaaggagaaaaagcaacagttcttggtgaacaaaaggtgttacgttttagcgaaaatatgcaactgagtaccttagcacctcattcgacatttaattattaaggatataactatgatacagtttaattctattgtggctattcttggcattatcgccacggtttatcttctcattaaaaaatatgaaactcgtacagtattaatcagtgttggtttgttgatggcaatgttgactttcaaaccaatggaggcgtttgatgcttttgctaaatccatgaccagtagcggtttaatcatggctatttgctccagtatggggtttgcttatgtgatgaaatacactcaatgcgatacacatttggtacatttaatgactcgtccgttaagtggtttaaaattctttttaattccgattgcaacagttattacgttctttattaatattgctattccgtcagcagcaggttgtgcagcggctgttggtgccactttaattccagtattgaaaagtgcgggtgtacgtccggcaacggcaggtgcggcgattttggcagggacttttggttcaatgatgagtcccggatcttctcatagtgcaatgattagcgaaatgtcgaaattgaccattaccgaagtgaatttgtctcatgcaccttacactatgattgcaggtgcaatcggcacagtagttttaactttgttagcgattgtatttaaagattacggtgaggaacatcggaaagcctatttacaagaaaatcaacaaacggaaagtactttcagtaaggtgaatatattctatgctttagcacctctcgttccgttgattatattggttctcggcggaacctctttagctgaaaacccaggattagcgtggacaaaaatgggcgtgccacaagcaatgttaattggtgcgatttatgccattttagttacccgaatttctccggttaaaattaccgaagaattttttaatggaatgggtaattcttatgccaatgtattagggatcatcattgccgcaagtgtgtttgttgcaggattaaaagcgacaggagcggtagattccgctattgaatttttgaaacattctaacgaatttgtccgttggggagcgactatcggaccattcttaatgggtttggtaacaggttcaggtgatgctgcggcaatcgcatttaataccgctgtaacaccacatgcagtggaattgggttatacccatgtcaatttaggaatggcggcggctattgccggagcgattggacgtaccgcttctccaattgcaggagtaaccattgtttgtgccggtttagcaatggtaagtcctgtagaaatagtgaaacgtactgcactgggtatgattttggcaaccttatttttaacgttatttatgttataaatataagtaatactgaccgcactttgataattcatttgataaggtgcggttaaagtttggagagtttaatgggggatatatgacgaatttagctaggttaattgaatggcgaagagaatttcaccgttttcctgaaactggttggacagagttttggacaaccagtcgcatcgctgattatttagaagaaatgggggctgagattttactcggcaatcaaattattcatcatgattttgtgcgtggtcgtgatacgaaattagttgagaaaggcattgaaagtgctatttcttatggtgcaaaaaccaaatggctagaatgaatggctatacaggttgtgttgctgtatttgattctggtaaacagggaaaaaccttggcattacgctttgatatagattgtgttaatgtgactgaaaccaatgatcctaatcatttacccaataaattaaaatttgcctcattaaatctagggtttatgcatgcttgtggtcatgatggacacatcacaattggtctaggtattgcgtcatggctttcacaaaataaggataaatttaacggtaaagtcaaaattgtctttcagcctgctgaagagggagtgagaggcgcagcagctattgctgcaagtggagtgattgatgatgcggattattttgcctcttcccatattagcttttgtgccaacacaggtactgtcttagcaaatcctcgtaatttcctttccacaaccaaaattgatattcgttataaaggacgacctgcacatgctggtgctgctccacatttaggtcgaaatgcattattagcagcggctaatgccgtaacacaattccatagcattgctcgtcatggtgaggggatgtctcgaattaatgtaggtgtattaaaagcaggtgaagggcgtaatgtgattccgagcagtgcggaaattcaacttgaagtacgtggtgaaaataaagagattaatcaatatatggtggatcaagttatgcaaattgccaaaggcattgcgattagtttcgatgtaagttatgaaactgaaattatgggtgaagcagtggatatgaataatgatcttgagttagttaaattgatcgaggaaattgccattcaacaacctggaatcaatgactctactgctgattatgcgtttaatgccagcgaagatgcaacgattttagggcgtcgtgtgcaagatcacggtggtaaagcgatttattttattattggtgctgatcgtacagctgggcatcatgaggcaaacttcgattttgatgaaaatcaattgctgactggggtaaatatttatattggtttagtacagcggttattggggtagtattgagtttttaatttattttcgattaaaaagtgcggtcagttttttatgaaaattaaaactactgcatttcctgtctattgaattattaacagttctagcagttttttttgctttcaggtacaatcagccgattaaattttatcttatattaatgaaaaacttttagattttatttttatgaaaaatattcgtaacttttctattattgcacacattgaccatggtaaatcgactctttccgatcgcttaattcagagttgtggcggtctttctgatcgtgaaatggaagctcaagtactggattcaatggatttggagcgtgagcgaggaattactattaaagcacagagcgttactttaaattacagagctaaagatggtgaaacttatcaacttaactttatcgatacaccgggacacgtggatttttcctatgaggtatctcgttctttagcggcttgtgaaggggctttattagtagttgatgctgggcaaggcgtagaagcacaaaccttggcaaactgttatacagccattgaaatggatttggaagttgtacctattttaaacaaaattgatttgccggcggcagaacctgagcgagtcgctgaagaaattgaagatattgttggcattgatgccattgatgcagtgcgttgctcggcgaaaaccggtgtgggtattgaagatgtattagaagaaattgtacgtaagatccctgcccctgaaggtgatccgaatgccccgttacaggcattgatcattgattcttggtttgataattatttgggtgttgtatctttagtgcgtgttaaaaacggtattttacgcaaaggcgataaaattaaagttatgtcaacgggtcaatcttataatgttgatcgtcttggtatttttacaccaaaacaagtagatacaacagagctgaaaacaggtgaggtaggttggcttgtttgtgcgattaaagacattttaggtgcaccggtgggagatacattaacttcacatcataatccggcaacctctgtgcttccgggatttaaaaaagttaaacctcaagtttatgcagggcttttcccaattagctctgatgattatgaatcatttcgtgatgccttaggtaaactaagtctaaatgatgcgtctttattttatgagcctgaaaattctaccgcacttggcttcggttttcgttgcggttttttaggacttttacacatggagatcattcaagagcgtttagaacgtgaatatgatcttgatttaatcaccactgcaccaactgtggtttatgaagtggaacaaaccaatggcgaagtgatttatgtagatagtccggcaaaattacccccactaaacaatattgctgaaattcgtgagccgatcgcagaatgtaatatgcttttgccacaatcttacttaggtaatgttataacactttgtgtagaaaaacgtggagtgcaaacgaacatggtatatcacggtaaccaagtggcactgacttatgaaattccaatgggtgaggtcgtgttggatttctttgatcgccttaaatcaacttctcgtggttacgcctcgttggattatggtttcaaacgttttcaagcagccgacatggtgcgtgtggatattatgatcaacggtgaacgagttgatgcgttagctttaattgtacataaagacaatgcacaatatcgtggacgtgaattggtggaaaaaatgcgagaacttatccctcgtcaacaatttgatattgctattcaggcggcgatcggcaaccacattatcgctcgttctactgtaaaacaattgcgtaaaaacgtattggcaaaatgttatgggggagatgtaagtcgtaagaaaaaattgttacaaaaacaaaaagaaggtaaaaaacggatgaaatctttaggtaatgtagaagtaccgcaagaggcgtttttagctattttacatgttggtaaagataagtaaggaaacaccaatgtctaaatcaaatttatttttcgttatattaattgcagcgggatatgccatttggaaattgcttgatcatttggcactaccgaatacattcaatattttattaattttattgaccgcactttgtggtgttttatggtgctataaccgttttgttatcttgcccaagcggagcagacaaattgctcgtgcagaacagcgtagcggtaaaatattaacggatgaagaaaaaagtaaaattgagccgatttctgaggggagtgaattgttagcttccctatttcctgtattgactttcgtacttattttacgttcttttctttttgaaccgtttcaaatcccatctgtttctatggagccaaccttgcgtgtcggggattttttattggtcaaaaaatatgcctatggcattaaagatccgatttttcaaaacacacttattgaaacgggaaagccgcaacgtggtgatataattgtctttaaagcacctttagaaccaaatattgattatattaagagaatagttggaatatccggagatcgtgttttttatgatgaaaaaacgcgtcatgtgacaattatttataataaagacggcaaagaatgtgtttatgattgtcaaataaaggaatttagttacagcgagccacagcgtaatcctgaatttactatgatcgttggtaaggatgcacaaggaaaagctatctatggcgatgaaaatcctttggtcttaactgagaaaggcgatgtggaacatcaaattcattgggatccacgcatttttaaccgcacttatatgtacagtggttaccgtcagcaaaaagattacgtaaccgaatggattgtaccggaggggcaatattttgtgttgggtgacaaccgagatcagagtgcagatggtcgtttttggggtttcgttccggaaaaaaatattgtaggtaaagctgaatttatttggttgagtcttgataaaaaacaagatgaatttccaaaaggcattcgtttttcaagaatgtttacctcaattaaatgacaaattattgacttaataaaacgccctttaaattaaagggcgtttctgtgttatgaaaaatccggtaaaagtgcggtagtttagtcgcaaaaaataatatgcctttcttttattttcaaatagattaaataggggtattatgttccattatttttgatgtggaacatcaaatttacgtttcttattgatattcttgaaaaaaattatgcaactggaaaaattacaaaaaaaattaggtcaccaatttactaatcttgattatcttaaacaagcattaacgcatcgaagtgctgctgcatttaataatgaacgtttggaatttctaggtgattccattctaaattttgctattggcaaagcactttacgaaaaatttcctaagtctaatgaaggtgaattaagccggatgcgtgcaacgttggttaaagaacaaactttagctgttgtggctcgccaagttgaattgggtgattacttaaaactaggtgctggagagttaaagagcggtggatttcgccgagaatctattctatctgattgtgttgaagcgttaattgcagcgatttatttagatgcaggaatcgatgttgctttagctcgagtttatcagtggtatcaggaattacttgaacaaataaaaccgggagaggcacaaaaagatcccaaaacacgcttgcaagagtttttgcaagggcatcgcttaaaacttcctgaatatgaagtgatagaaattaagggagatgctcacaatcagtcttttagagtgagctgtaaagtggaaacacttactgacgtcgtttttggacaagggactagtcgccgtaaagcggaacaacatgctgctcaacaagctattgaaaaattgaaaattaaataactatacccgtcgggacaatatttttttgtccttgcataatatgagagaaaaaatgacagaacaagaaacttattgtggttttatcgctattgttggacgtccaaatgtgggtaaatccactttattaaataaaatcttaggacagaaaatttccattacttcacgtaaagcacaaacaacaaggcatcgtatagtcggtattcacactgaaggtgtttatcaagcggtttacgtagatacacctgggttacatattgaagaaaaacgtgcgattaatcgcttgatgaatagagcagcgagtagtgcaattggcgatgttgatctgataatttttgtggttgatggcacacactggaatgacgatgatgagatggtgttgaataaattacgtcgtgcaaaagcacctgtcgtgttagcaattaataaagtggataacattaaaaataaagatgaacttttaccttttattacagacgttagtcaaaagttggagtttaaagaaattatcccaatttctgctcagcgaggtaataatattcacaatttagaaaaaatagtccgcacttctttacgtaaaggagtacaccattttccggaagattatgtgacagatcgctcacaacgctttatggcatctgaaattattcgggagaaattaatgcgttttacaggggaagaattaccctactccgtaacggtggaaattgagcaatttaaacttaatgagcgtggtatttacgaaattaatggcttaattttggttgaacgtgaagggcagaaaaaaatggttatcggggcgaaaggacaaaaattaaaaactatcggtactgaagctcgtcaagatatggaacgtttatttgataataaagttcatcttgaactatgggtaaaagttaaatccggctgggctgatgatgagcgtgcattacgcagtttaggttatatagacgaataaaataaaacattaaggagacaaattatgtacttggaacaagtgaaaactgagttattggaagcacaagatgtactaaataaatttatcagtaacgaacaaaatatcaagctcattcaacaagccgcattactgatttcggatagttttaaacaacacggtaaggtattatcttgtggtaatggcggttcacattgtgatgcaatgcattttgcagaggaactaacgggacgctatcgtgaaaatcgtccggggtatccggcgatagcaatctcagatgttagccatttaagctgtgtaagcaatgattttggctatgaacatgtattttctcgttatgtagaggctgttgggcaaaagggcgatgtattattaggcatatcaacctcaggtaactcaaaaaatgtattaaatgctattgaagcggcaaaagccaaaggtatgaaagtgattgccctgacggggaaagatggtggaaaaatggcgggacttgcggatgtggaaattcgtgtacctcatttccgttttgcagatcgtattcaagaaattcatattaaagttattcatattctaatcatgttaattgaatttgagatggctaaaattagacagtaattttttaacctttttgtactattacagagaaagattttatgtcatattacaataatgcaatcttccctttgcttttagtgtaaatttagattaaaatcgcaacccttgttttagggtcaataattcgtttattgaacaatattaaattttgcaaaatattaattaatcattgaggtgatggcttatgccagtaattaaagtacgtgaaaacgaatcattcgacgttgcattacgtcgtttcaaacgctcttgtgaaaaagcaggcatcttagcagaagtccgcagtcgtgaattttatgaaaaaccgacaactattcgcaaacgtgaaaatgcaacgcgtgctaaacgtcatgcgaaacgtgtggctcgtgaaaatgcacgtaatacacgtttgtactaattaaaaaatttttttaattaaactcgagttaaacagaccgtgaaacctcataggaatcacggttttgtttcttttataaattctctatcatatttgcttttatagtattattaggctagtttattcctatttgatgctattttagggattcatcttttttatgtcaggcaaaataccgcattcatttattgatgatattttagctagaacagatattgtagatctgattgattctagggttaaactcaaaaaacaagggcgagattatcaagcctgttgcccttttcatcatgaaaaaacaccttcttttacggtgagtccgaaaaaacagttttatcactgttttggttgccacgcacatggaaatgcgatctcatttttaatggaatatgataagttagaatttgttgaggcaatcgaagaactggcttctttgcatggtttagaagtcccgagagagaaatctacgcttgatgaaaaaacacgagttagttttaaaactaaacgcaatctgtacgaactaatgcaagaaattgcaaaattctatcaagagcaattaacgcaaaatatccccgcacagaattatttacaacagcgtggtttatcaatagaaattattcaacgttttcaaatcggcttttctccacagcaatctagtttttttataaaaaaatttgccacaaatagagaagaaattcagaaattatttgatgtgggaatggtaaataaacgagagagcggtgaattatttgatcgttttcgtcagcgagttacttttcctattcgagatagaagagggagagttattgcttttggggggcgaattattacccaaagtgataacagaccgaaatacttaaactctcctgagagcgtaacttatcataaaggttatgaactttatggtttatttgaagcgttacaaattaatgatagtcctgaaatgttggttatcgttgaaggctatatggatgttgtagctttagcacaattcggcgttgactatgctgtggcatctttagggacagcaaccaccactgagcaattacaattagcctttcgttcaacagaacaaattatttgttgttatgacggtgacagagcaggaagagatgcggcttggcgtgctttagaaaatgcacttcctttattggaagatggtaggcaattaaaatttatttttttaccggagaaagaagatcctgatagttttattcgacaatatggcaaagaaggatttgaggattatattcatcaagcacaatcattaagtgaatttttatttaatactttaagtgctaaagttgatttttcctcaacagaaggaaaagccaaattagcttctcttgcaattcctttaattcagaaagtgccgggagaaatgttacgattgtctttacgtgatatgttcggtcaaaaagtaggcatatttaatccggacaagttagatagattactatccaatcaacaacaggttgaatataaacaaaaaattccgaaaacagtaaaaagaacaccgatgcgagttttaatcgcacttttattacaaaacacaaatttagctaaaattgtccctgatttatcgccactaaaagttttacaagagccgggcttggatttatttgaaaaaattgtaatactttgtcgtgaaaatgttggtatacgagctggacaaattttggaacattggcgagacacggaatatagccaagcacttgaaattttagctacgtgggatcatgctgttgatgatgataaaattgagcaagaatttagagaaaccttgattcatctttataagcagttagtcgataagcgtattgaagaattaattggtcaagaacgtatggttggcttaactaatgatgaaaagatagaattagcacaattattatcgaaaaagcaagaaaagaaatagttaatcttttataagaatggtagaattctccattcttcaatccttattaatcgaggcagatattaaatggaacaaaataaacaatctcagctgaaattgttaattgcacgaggtaaagaacaaggttatttaacttatgccgaagtgaatgatcatcttcctgaagatcttgttgatgctgatcaaattgaagatgtgattcaaatgatcaatgatatgggtattcaagtacttgaaagtgtgcctgatgctgatgacttgatgctcaatgaaaatattacggatgaggatgctgttgaggaagcgactcaagtattatcaagtgtagaggcagagttaggaagaacaacagatcctgtgcgtatgtatatgcgtgaaatgggaagtgttgaacttcttacgcgtgaaggcgaaatcgatattgcaaaacgcatcgaagaagggattaatgaagtacaaagtgccgtagccgcttatcctaaagctctcaattatcttcttgaacagtatactttagttgaagaaggcggtatgcggttggctgatctcattaccggttttgttgatccaaatgcggttgttgaagaagagataattgaagccgacgacatacttacagaagatgatgaagaacatgtagaaagcaatgttgatgtaaacgatgaagaagaggaagaagatagcgaagataatagcaatgtagactctgattcggataacacaattgccccagaagttgctcgtgagaaatttgaagcactacgaatgcaacaccaaaaaaccttagccgcaatagaaaaatatggtcgttcccgtaaacaagcaaaagatcatattcaagcattagccgatatttttactcagttccgtttagtgcctaaacagttcgatgcgttggtcaattatatgcgtgatatgatgaaatctgttcgtcagcatgaacgacaaattcaaaagctggtagttgatttggctaaaatgccaaaagaaaatttccaaaaattatttattggtaatgaaagttcagagggttggctggataaattactgcttgcaagaaaaccttggtctgaaagattaatacaacatgaaagtgcggttcgtcaaagcataaaccaattattaaaaattgaacaggaaaccaatttaactatttctcaaattcgtgaaatttgtgacaaagtggcacaaggagaattaaaagctcgccgtgcaaaaaaagaaatggttgaagcaaatttacgtttggttatttcaattgcgaagaaatacactaaccgtggattgcaattccttgatctcattcaagaaggaaatattggtttaatgaaagcggtagataaatttgaataccggcggggttataaattttcaacctatgcaacttggtggatacgtcaagcgattacacgctctattgcagatcaagcaagaacgatccgcattccagtgcatatgattgaaactatcaataaattaaaccgcatttctcgtcaaatgttacaaaaaatggggcgtgaagccacatctgaagaattagctgaacgaatgggaatgcctgaggataaaattcgtaaagtattaaaaatcgcaaaagagcctatctctatggaaacgcctatcggtgatgacgatgattcccacttaggtgattttattgaagacaatacgttagagctaccgttagattctgcgacagcccaaagtttgcgtgctgcaacgcatgaagtgttggaaggactaaccccaagagaagcaaaagtcttgcgtatgcgttttggtattgatatgaatacagatcataccttggaagaagtcgggaaacaatttgatgtaactcgtgaacgtattcgtcaaattgaagctaaagcattgcgtaaattgcgtcatccaagtcgttctgaaaccctacgcagtttcttagatgagtaaatgatgagagtaaagaaagttatcacattcttttctcaaacattttggcacgacaaataatcaaaattaacctaaaaaatataatccctattgaaagaaatggctcaatagggatttttcgttatgctaaaaagtgcggtgattattcaatcctatttgagcatcaaacatttttaattgttcgcctcaattaagttaggataaaaagtaaaaaaatcgtttctttcctataaaaatttaggataaaatagcgagaattttcacttgacaaataaaatagaacggaaaaaatgacagtctacagtctacagtctacagtctacagtctacagtctacagtctacagtctacagtctacagtctagtatattggctaaaatcaacctttcaagttaattttgagaggttggacatgttcaaacaatatcttaaaaatcacctatttcaacctcaacctttcggcgaaagtattattcgcctttttttgttgtgtcttaaaaagcaaggcatcgccgatttaggtttataatctatctnnnnnnnnnnnnnnnnnnnnnnnnnaagagataataaataaacaataacagattcgatcaataaccacttaataagtaattaacagataatttttaaagcgagtaaagaatatgaacaaaatcttcaaaaccaaatacgatgtaacaacgggtcaaacgaaagttgtgtctgaattggcaagcaatcgccaaatagcgagcagttcgaagagtaaaccgaagtgcggtgcgttttggggtaattttttaggcatttttaaattttcaccgttggcgttgttgatgtcggggatgcttggtgtgagcagtgtttcatatgctgatatagtatatatagatatggaagcaactacaggtgctgctggagtaagagaaaaatggagtttgtcaagttattggaaaaatactggacgtgaaaatattttaatagcacctgttcaacctaatagaaataatcaaaatttaaataggtatggtagtagaataaatacaaatgtacaaaaatctgtaatcataggtcctatggcggcaggtagagatgagcaagttggtatgactgtattaggtcatggtgcagtcggttatagtagtcaaacaactgcgattgggaataatgtctatgctggaggcgggcaagccacagcgataggttcagatgttatggcagcaggttacgcttcgattgctataggtaatgatgatatcttgagccaaggtggatacgccgacgcattaccgcaagatcttattatgaaaatttatgggtatgatggaaatcataacggaaaaactacttataaggacatattagacagagatatatttgtagataaatatgggaaaaaacctaatcaagatmatagacactattctccaacttattcagcmggaatrggwgcaatmgctatyggktcaagatckgttgcytatggkgatacttcacttgctttaggracyttatcatttgctttrgctaaaggctcaaccgctgttggygttcgtgcwtttgtgagtgaagatgcagaaggtggggttgcgataggggatgagtcaagagtttttgctgctaactcatttgctataggaaatgaagccgaagcaactaggaaaggggcaatatcttatggttctggctcaaaagcagtaggagaaggatccatcgcaataggtaccaaagtagcttctaatgctaagatagatgaggcttcagctcaaaaatttagaaccaaacttatgcaagaactaggtattggaacgattcgggaagataaacaaaaagatgttaatacaataataacaactggagttacagatcttaaaaccggagatcagaatgagattgttaaatctgggtttgctaatcatttagacgataaaaaaattaacagtaagattaatcaggttcttaagggattagatttaaaatatcaagaagaaggagatgagtttttatcaacaacgactgatggcaagaaaaaatcaataaaaaagaaagcaaaagagggggaacatgctataactataggttattacactattaataatggagataataccgtagccataggcacagcttcctatgtaaaaggtcaaaattctgtcgttttaggggctttaaacaatgtcggacaatatgcaagtaatacgatagcgattggggttgggacaaatgtacataaagaaaactcaatcgctttaggaacgggaacaacagtaacaggtgcgggcgttgtggctatcggttccggcgttggtgtaacaaaagacaatacaatagctatgggttatggagccttaggagaatcaagtgaaagcatcgttttaggaaatagtgccagtataaaggatcaagcaaagaaatctatagttattggtaatggtgcaaaagttgaaaatcaagatcctgaaaaagacagtaacttaacgaagttaaaatggtcgacaattggagatgataggcataaagtagaactagaaatgtccgctattgctatagggacaggttcatctgtttatgctgtaaagggcgtggcattaggagataacgcaagtattggaaaagatgctcatagttcaatggctttaggcaatgaaaccaaagcagatatgatgaactctgtcgccttgggctatcgctccaccaccaattatttttatgataaaaacgatgccaataaatctaccgctgttttgagtggaaaagacagtctaagtgcgatggaattggacggctatgtgccggaaggatctagctataaaattttcaatgataaagctgctgggattatttctgtgggtggttgggataacggaagtgcttcccgtgctacaggcgatgcgaaaaaaagtgcggtcggtttacgtcggattgtcaatgtggcaccgggtgctttggactctgacgtggcgaccgtggggcaattaaaagccttgaactacgtcaaaaaggaaggtttggtggtttattacaccgttaaagaagacggaaaacctgttaaactgaccaaagattctaatggtaaattctatgaagttgacaccaaaactggtgaaccgttgaaagattctcaacctgtcgataaaagcaaagtcttagtcggggcgaaaggggcgaatgaggtgattggttcgcaagatcttggcgaaaaaatccgttttgggcatttagcgaaaggggagatttcagaggtttccgatcaggcgattactggggcacaacttgatgatcttaaaggtaagttggggttgacggtaaataaagatgatccaacaaaatttgataaagtccaatttgatgcagtaaatgtaaccgattcaagtgatacatcaggagtaataacaacttttgaagatgctatccgtaaaagtattgcagctatcaatagaggctataaatttgatgatggaactaataatcctaatactaaagatacacctttttatttaggttcaaccattgtaatcaaagcaggggatgttacaaagtcaggtgcaacgatagagaaatatctaggcaaaaacctaaaaacagaatttaaaaacgatagttcaaaagcgacattcaccatcggcttgaaagamgatccggaatttaagactgtaaagattgacacgattgaggataaagaaactactgataaaaaacttgccgtcaacaaagagtatgtggataacaaactcaaaaatgtctcgaccaatttacatttcttatcagtacaagggatggataaaggcaatgcagcaaactataacaacgacggggcaaaaggcactcattctgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatgtaaaaaattcatttgtgctagggtctaataatacagttacgcaaggctttaaagagacaaatggtgcrgtggttgtnataggtagtggaacagaattaatagaatctaaaagttctatagcaataggtgcggtttttgcgaaaggtaaaaacggagaagatggaacaaaaatagaaaatgccgcttggacagcstctatcggkaayaaaaayaaaatcaaaaacggtacggatattgtggcgttagggaacaatattcaagcattagatacgacaggtgaagcagctaacaacggtacaaaaaatgcaaatacagaattaattttgattggtaatgcttctaaagccacatcagcaaaagaaagtgtaattattggrgcaaaakcaraagctgaaacgggtgcaaaacrwgcsgttattatcggtcatagtgctaaagctgagagagacgccgtcggtgcggtagcgattgggcaaggtgcaacagtaaaaaccgacgccggcaactccattgcgttggggcaagggtcagaagcgacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaatccgttgtcagcctaggcaataaaggcaaggaaagacaaatcaaacacgtcgctgcaggtgcggtagataaaaattcaaccgacgctatcaacggaagccaactttacgctgtcgccgatgaattttctaaattagcggtgaatgtattgggtgcggaagttgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttggtcaaaatacaacagcgattaataaaggctttatttttggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaatacttatgataactatgctgtcaacaaaaaatatttagacaaaagattagaaaaagtcgcagctaattttacggttaagggtgataatagtaaggataataaaggttatacattagataaagagcataatgaattaacaattgcaggagatagcaaaaatatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtaacattaactgaagataaattcagtggtgtgtctgaaattagcagtaaagacagtcaatctaagttaacacttggtgctgataaagcaactgtagaattagaacatggcaaatcaaaacttgaattaaaagatagtgagacaacawtgastgcagggactgatgccggaaatattaaaattaccaataacggtgataagaaaattgagttaagtcctgaaagtggagctaaattgacacttgaaaaagataacagctctagcaatgttaaagctaccggtttatcgactgttgggttaagtgatgataacgctttaatctttaaaaataatgatagtaaatctgcggagttgaaagtaggtactagtgcaacctataaattcactgacagcggattagatttagctagtaaaccaatcacaaatctaggaagtgggttagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaattaaagaaagccatcaatgcaggcgatttgcttcatgttgctcaaggcttggtgaataaaggcttgacgtttaaaggtgatactggcaatgaatttactcgtcaacttggtgcaacagtaaccattaaaggcgacggaatggatctaacatcaaaaaccgaaaatgatgctattacctttactttaaataaagcaacttctgtagataaaaatgacgaaaaagtcgttacctcaaaagccgtagcaaaggagttggaaaaatataccaagactactgatttagttgataagttaggcacggcgtatttgaaaatagatggatcgaatattggcgatgcttccaataaaaaaacattcggtagcaatgtcggtattgctgaaatcaagttagatagtgacaagagcgacactgaattagtacaagctaaagcggttattaagtacctaaaaggtactaaaaatggctctgtaaaaatctctgattcaccggaaactaaagctgatggggataattcaatcagtataggtctgaaagccgttacacaaaatgccgactccattgcaattggctataacacaagtgctacaaatcgcaagtcattggtgttaggtagcgatagcaaaatggacggcgaagagtctgtggcaatcggttcaacaaataccgtgagcggtaaatattcaggggtattaggaaaaagaaacacggttagcggagagcattcctatgctgtgggtgcttataatgaaatcaagggcgaacacacttatgtcttgggttcaaatatcacgacaactaaagatataacaaatgctgttatcttaggtaataactcaaaaggtgtgaacaatgcggtgtctgtgggtagcaaagatgaacaaagaagaattgtttatgttgccaatccaacgaataaatacgatgcggtgaataaacaatatgttgatggacttggattaaaattcaaaggtaatgataaccaagagatacacaaaaaattatcacaaactttagaaatagttggtaagggattaaataaaaaccaaactactaaatttaatggcacaaatggaaatattgctgttataaataataagcaaaataaattagaaatatcattaaatagagatttaaaaggaattaaatctattagtgatagcaagaataaaaatatagccactgaaataagattcaatagaaaaaatgacacaaacagtatttctaatagtttgataacgaacctaactatttcttcaaatggaggcacatttgaatttaatagaaaaggtttgcatatcaacaataaacaaattacagggttaagaagtggattattagaaaaacacaacggaaatgattctgaaagaaaaggtttagacgatttaataggagaaaattttgataaatcatcgattaaaactcatgcagtcaatgtaggagatttagcaaaaatttctaaggaaatagttgaaaaaggatataagtataaagctgatattccgtcaggtaatagcaatgataccagcataaaactaggctcaactatatctattgttaaatggacaaactcgccggcatcggggactggacaaccagcagtaactgttggcacaggaataatttctcaaacaccagctgttaattacgatggctctaatttacaaactagatatacctatgacggtggcaannnnnnnnnnnnnnnnnnnnnnnnnnnnnnnnnnnnnnnnnnnnnnnnnnnnnnnnnnnnnnnnnnnnnnnnnnnnnncggaaatgcagttgatggcaaagaactcatcactaaaggctaccttgaacaagcgttagataactttaagttcaaggttgaaaatggtagcggtaagcctatagaaatcggtcgtggcgatacgttgaagtttaatgctggcttgaatattcaattaacgttagctaaagagggtgaaaaaccggaaaatggggcaacgtctgaaagtagcacaagtgaggtaacttctaccccagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaagcgatacgagtacaccaaccactactgcaccaaaaacagtagagctaaatattgcaacggctgaagatttgaaaaatatnnnnnnnnnnnnnnnnnnnnnnnnaagtgcgggcggaagtagtgcaaatggtgcaactggagaagtgacgaaacttacgttagatccgactaagggggcgactttccaagtgggcaagcaaggttctcaagtcactattnnnnnnnnnnnnnnnnnnnnnnnnnnnnnnnnnnnnnnnnnnnnnnnnnnnnnnnnnnnnnnnnnnnctgactcaccatcaatcactattaacgcaggttcaaaaccggcagatcaaagtggtctagaatcgtttgagaaagatcaaggtccatctattgcgttctccacaaaaaatactgacggtaagaaaatcggctcaggcaaaatcaccggtcttgctgatattaaasmggrkgaaaswgacggcaccmktgcarcgaataaaaactatgtsgatgrmaaagtatccgacttaaacaataaycgyccrtttgatttttatttagrcaakgaaaaagtmgtkaaagggrmwgatggnartttccacaaagcagacaaacctgctgaaaaactttctgaggaagagaagaaacaagtcgtgattaaagccgaaccgaccaccgcacctatcgggattagcaatgtggcgagtggtttgggattannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaagcacaaactttcacggatttagcattagcggtaagtagcttagaacaagcaataaatgcgttgccagagggcaatgataaaannnnnnnnnnnnnnnnnnnnnnnnnnnnnnnnnnnnnnnnnnnnnnnnnnaaaaaagagcttgaaacagcgaaaagcgagctaacaaaagctcaaaaaggcttaacagaagccaataaagggtatgagaaaaattacggaggctatgaaaaagttgcagagttagtaaatgccgatagcaaaatagatttaaccaacgcagcaacaatcggtgatttgcaagcggtagcgaaatcgggcatgaagttcnnnnnnnnnnnnnnnnnnnnnnnnnnnnnnnnnnnnnnnnnnnnnnnnnnnatcacaggcgagggcgacacatttaacagcgaccgcactgccaccggcaatatcaaagtggaaatggcacaagacggtaaaggcttagaagtgaaattgtctgatcaattgaaaaatatgacttcgtttgaaactcgtgaagtgaacggtaagaaagcccgcttggacagcaacggtttgagtgtggaaaatacaagcacaaaagaacgctctcatttaagcgaaaaccgtttggcgttctatgatgaaaaaggattgggattgaatttagatggcaaagatcgagccttaaaagtgggtgaaaaagcgattattagcatcaacggcaaaaatgaggctttagttgaagatctcaatgcctctagttcaggtcaggcaattgcgaataaaaactatgtggacgcaaaaaataatgaattgcgtacacagcttcatagtgttaatcgtgaatcacgttcaggaattgccggtgcaaatgcagcagctgcgttgccaatgattgcgatgccgggtaaatcagcacttgctgtctctgctggggcttataaggggcaaagtgcggtggctttgggctactctcgtatgagcgataacggtaagattatgttgaaactacatggcaacagcacctcaaccggcgattttggtggcggtgtcggtattggctgggcatggtaagtaacgccctttgagctaaaaaagcagtgaatgatgatctgctccttaatcagttggttgtttagtccaacttttgggtgcagatcggaatcactgcttttttgatgcggatttactatgatactttttaatggtgatggaactgtaatatcatcaccagcccagtattagtcttaggtgaaagcggttagaatatattaacttctgtcctcgaaaaagaaatattcattgagggtgatagaagaaattcactgatgtattaggggagttagtaggaatttcgttttttagagagaggagaacatcaatatatgaaatattcgtttatttcataatgaatcggcatataatgtcaacctttcatgttaaataaaggattcgcattatggaattttctgtttatctacaattttttattgggttaattgcgttggttaatccaattggggttgttcctatcttttatatgatgacatctggtcaaagtcgtgttcagcaaagtcatactgctatgattacttgtttttcgattgtcgttattttattgatcagtttttatttcggtaatttcattttaagttcgttcaatatatcgattaattcattcagaattgccggcggtattgtcgttgtgatgattgctttaactatgattaatggaaaaattggtgatcacaaaattaataaagaggaacaaaaagaggattttagcgaaaaagataatattgcagtcgttccgttagctatgccaattttagcgggtccaggatcaattagtgctactattgttctaggttctagtcagagttcatggagcgaatacttatattcgtctattacaatcgcactttttggtttaacttgttatattttatttcgttattcagagccagttatagaaaaattaggtaagacaggatcaaatgtaataacaaggattatggggttattgctaatgtctttaggtgtagaaattatcactaccggcttaaaaaatataggcgttttttagcttcaaagtcatattatccagtaaaaaatacaccgcacttttttatgctaaacattgttttttttcagtataataaaaaacattttttcacaacaatgatggaacaataattatgataaatacaaaatttaatgtaaaaacctttcaggggatgattcttgccttgcaagatttttgggcaagcaaaggttgttccgtagttcagccttttgatatggaagtaggtgcggggacatcgcatccaatgacttgtttacgtgctttgggacctgagccgatggcatttgcctatgtacaaccctcccgacgtccaactgacggtcgttatggtgaaaacccgaaccgtttacagcattattatcaattccaagtggtgatcaaaccctctccggataacattcaagaactttatttagacagcttaaaaatgctcggtttcgatccaacccaaaatgacattcgttttgtagaagataactgggaaaatccaacacttggtgcatggggtttgggctgggaagtatggctgaacggaatggaagtgacacaattcacctacttccaacaggtcggaggcttggaatgtaaaccggtaactggtgaaataacctatggcttagagcgtttggcgatgtatattcaaggtgtggacagtgtatatgatttggtatggtctgacggtgaatttggcaaaactacttatggcgatgtattccatcaaaacgaagtagagcagtctacctataatttcgaatatgcagatgtaaatttcttgttccattgtttcgaacagtacgaaaaagaagctcaatacctaattgatttggaaaaacctcttcctcttcctgcttacgagcgtattttgaaagcggctcatagttttaatctacttgatgcacgcaaagcgatctccgttactgaacgtcaacgctatatcttacgcattcgtgccttaaccaaaggtgtggcggaagcctattatgccagtcgtgaagcattaggatttccggggtgtaaaaaataatgacaaaaccgattttatattttgcccactggtgccctgacaccgaaccgtttgtcgctgaactagaacgcttgggtgtggaatttgaagagtgcgacatcacaaagtgtggtgcaaatcttaaactttttttacgtcttcgtgactaccacccagcctttaatcacgccaaagccaaaggctatataggtattccggcattgttgttagaaggggataaagtggtgttggatttggcagaattagaagggatttnnnnnnnnnnnnnnnnnnnnnnnnnnnnnnnnnnnnnnnnnnnnnnnnnnnnnnnnnnnnnnnnnnnnnnnnnnnnnnnataatcaaggagaaaaaatgaaatatgcctttatcgactatgaaaacctgaattcattagatggtttagcattacaagagtatgatcgaatttttctctttattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttatattttatccaatgatcagggctatgatggtatttgtaactttattcaacataaaaaacaggggcggatttgtcatggaacaaacggcaactagaaattttccagtaagattggaaagcttaaaaaacaatattcgtagccgttgcggtttaaataatattgatataaaagaggctgaaaaattggttgttctagtaattgataaattgctttcagaaaaagtaataaaaattgctgataacaaagtaagctatcctaagcgatagcaaagagtgaatttttattatttatgccactttcttttaagcagaaagtggctaaaaatttaaatactcggattgaatttttctatcaaaatgtgagctgacattctgtattacatgaagatctacatcataattaaaccaagtttattattttgtcatgtcgttaggaaaatgatgatgagcgtaaactggcaaaagcaatatccgccgcttgtaaagtgcggtcaatatctgcgtcagtgtgtgctaatgacatgaaacctgcttcaaatgcagatggtgcaagataaacaccttgttctaacattttgtggaaaaatagattaaacttttcaacatcacattgaattgcttgttggtaagaggtaacttcattttgtgtggtaaagaagatgccaaacattccgcctacataattgactacaagcgggatattatgttgatttgctaagttttttaaacctaatgccaatttttttgtgagcattgctaaacgttgttcattaccttcttttctcaattcatttaagcatgcgattccggcagacatagcaattggatttcctgataatgttcctgcttgatatacgggacctgtaggtgcaatatattgcataatttcttttttgcctccaaaagcaccaacgggcatacctcctccaatgacttttcctaatgttgttagatcaggtgtcacttcatagtaagattgtgcaccgcctaaggctacacgaaatcctgtcatgacctcatcaataataaatagagaaccatattcattgcaaagttgacgcaagccttgtaaaaaatcctgtttcggaaggatgcagttcatgttacctgcaacaggctcaacgataacgcaggcgatttgatcaggatattgttcaaaagcatttttgacagattgaagattattatattcgcaagtgatggtatgtttagcaaagtcttccggaacaccgggagagcttggttgtcccaaagtcaaagatccggagccggctttgacaagcaaactatccgagtgaccatgataacagccttcaaattttaaaattttatctcttttagtatagcctctagccaaacgaatagctgacatagttgcctctgttcccgaattgaccattctcaccatttcaattgatgggactaattgacaaattagttccgcaagttcaatttcaagcggtgtaggtgttccaaaacttagcccattttctgctatttttagtaccgcacttaagattgatgggtggttatgacctaaaatcattggtccccaagaacctacgtagtcaagatattgttttccttctatatcgaaaatatacgcaccgttggctttttctatgaacactggcgttccgcccacacctttaaatgctctaactggagagtttactccgcctggaataacttgttgtgcacgagagaataatgtcgctgaagttgtcatgataaatcctttaatatattgttaaaaacacactttgtattctactgtaaatgaagataaatttataaaaatatttataatacgaggtttttcgatgttcttttacattatttattatgcacccaattgctcaacaaattgaattagttggtaaacacattatcgtaagcatcataaaggtgcaattcttccttatttcgtaacgaattttgtcattccgttgggttaagagaatgaaaaaagaacgcagagaataaaatcatgaaatgtaatatcacttcataaattttattaaaaaaacgtcagtttggataaaaaattatctaataataaaaaaaagtaaaaaaatgctagacaagtaattgtgaaactcttaatatacgccccgcaacgacgcgatgagcgctcgtagctcagttggatagagcgttggcctccggagccaaaggtcgcaggttcaaatcctgtcgagcgtgccaggcgacgttatatcaaatgtggtggctatagctcagttggtagagccccggattgtgattccggttgtcgtgggttcaagtcccattagccaccccaattagtcggcgagtagcgcagcttggtagcgcaactggtttgggaccagtgggtcgtaggttcaaatcctatctcgccgaccatttttgttctttaacaaactatcagacaaactgtgtgggcacttgtgagactgtattaataagagattaaaagagtaagataagtgcttaaactagagaaattcatagagaaaagatggatgaaatagtcagtatttattgagcgaagagattaaattgaagagtttgatcatggctcagattgaacgctggcggcaggcttaacacatgcaagtcgaacggtaacggggagggagtttactttctctgctgacgagtggcggacgggtgagtaaagcttgggaatctggcgaatggagggggatagccacgggaaactgtgggtaataccgcgtaaggtctaaggactaaaggggtgggactgagaggccacctgccatttgatgagcccaagtgggattaggtagttggtgaggtaagggctcaccaagctgacgatctctagctggtctgagaggatggccagccacactggaactgagacacggtccagactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggagtggacgcatcactggtgtaccagttgtttcgccagaagcattgctgggtagctaaatgcgggagagataagtgctgaaagcatctaagcacgaaacttgccttaagatgagttctccctaacgaagagttagtaagggatgtttgagactaagacgtagataggtggggtgtgtaagtgtagtgatatattgagctaacccatactaatttcccgaggggcttaaccatacaatcttgagtgttttgcatagaggaagaagcgggacaggatagagagaggaagacttgaagtagaggcttgtttttttattgaagaagagatagagacgggatataagagagaggaatttaacttggcggcgatagtgcggtgggaccacctgacaccatgccgaactcagaagtgaaacgctgtaacgccgatggtagtgtggggattccccatgtgagagtagggcaccgccaagttttttatgattttattttgttagtttatttatattagtaagctaacaaaacaagtttttttgcgactatagctcagttggttagagcaccaccttgacatggtgggggtcactggttcgagtccagctagtcgcaccaaatgaataaatcaatgtaacgcatagtaacgcatttcaacccaaaagccttgtataacaaggcttttttgctatccgattaacgctagttgcgtcaggataaatcacattgaccttgaataatagcacccattttagtacccacgcattataattagtttgattattgagtactaaaattatacaacctcttacaaatacacaagtagaaaaggcaaagtatataacaggaaacagggcagaactaaacgactgtgaaggcttatttttacagctatacccatccgtctcaaaaatttggcgatttcgctataatcaccctgtaacacaaaaaagaacaaagctaaccataggtaactaccctgatttttctattgctcaagcaagagcaaaaagagaagagtttaaagcattattagcataatacatagatccacaggcatataacgagcaacatagaacagagcaagaacagagcaaaaaaaggacgcttttagcaattgccgagtaatggaaagataaaagcgtgaaagagatagaacctctaacaatggctaaaaattgggagcgattaaataatcattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaatcatttatttcctcatttgggggcttactcaatagagaatattacccccccccttttttttactaattaatgctgtcaagcctctttacgagcaaggtaaaaatggcactatgcaccgcattataaatttagttaatcaagtattaaattacgctgttaatttgggtgttttatcatttaatccttgcttacaagctagcaaagcatatcacaaagaaccaccaaaaaaatcaccctgctattcattattctgaacttcccctattattggctgattttgaacaatctaacagagagctattaactaaatttttatttaggtggtaattgttatcaatggtacgccctgctgccgaagctgtttcagtggaatggagtgaaattgatttaaataaaaaatttggtttattatttctaaagaaaaaatgaagaaggttagaacggggagattttcgcattctgtacccttatcaagacaaatgataaaatattttagagcaattgaaaccaataacgggacatcataaatatgtatttccatcattcacaaaacctaatcaaacaatgagtaaagacacaattgctaatgcgttgcgtgaaataggctatcaaggtaaacaagacgcccacggattaaggacgattgcaagaacttatttagaagacaatatgattgattttagacttgctgaaagttgtttagctcacaagataggggataaggttagtcaggtctataaccgtgctgactacatcgaacagcgtcgcccaattatgcaactttgggggtatgtgcaccagaattttttaatcaatcaaattgacagtaaaacctagaaaaatcaatgtttctaggttttttatttatcaatatcatatgaatatcgattcattctacttattttggcaatactaacgaggatgatatagtagttgtggtcagtcctctgagtaaagctgagtaaaggcaaaatatgaattattttcatagtcttggcaaaaaatctcatttttcttaaaaaatttttatggtttaatacaccattattctaaaaatgagaaaaattaatatgatgacaacatttgaatgccgtgtacatacgcttgaatttgatgaaaattaccaaccagaaatgcagagtacccgtttaacgaccaactttgctaaccttgcgcgtggcgaaaaccgcaaagaaaatttgcaaaatgtcattgcaatgattgataagcgttttaacgatttggcaaactgggataatccaactaatgatcgttattctgtgaagttagagatcgtgtcaatagatattgatatggagggaaaaggtaatttttttccagcacttgaatggctgaaaacctatgtcatcgaccataaaactggcaaaaaaattgatggtatcgtaggcaacaatttttcgtctttcgtgcgtgactatgatttcagcgttttgttgttagagcataacagaaacaaggaagaatttaccgtaccgaaaggctatggtgaattgcatggcaagctattcaaatatctgttaacttcctctgcatataaagaaaaatatagtaaaccgccggtgatttgtttaagtgttgcaactactcgtacttaccgcagaaccacaaatgttcatccgattttaggggtggaatatcatcaagataattattctttaactgatgagtattttgcgaaaatggggttatctgtgcgttattttatgccaccaaaatctgttgcaccttatgcgttttattttgatagtaattcagatttgttgaatgattacaccaatcttgaattgattagtacaattgctacaatggaagctttccagaaaatctaccgtccagaaatttacaatgctaattctgtggcaggtcaagtgtataaaggtagcttgacttatcaagattactctgtgaccaaagtagaatatgatcgtgttgagcgtacacagcttgcaatcaaacaaggtaaatatactgaagcacattttattaagccatataaagcaattttagatgcttggatggctgaaaaataaatcaagacagtatttttatttgatacattcgtagggtgggttaaattccgcccctacacatttatttaggaaaaccaaaatgagcaaaattcttctcccaacctctacagccggtagtcttccaaaaccggtgtggcttgctgaacctgaaaaactttggtctgaatggaaatgtcagggcgatgaactttttcaagctaaaagagatgcactattaatttcccttgctgaacaagttgcagcagggattgatattatcagcgatggtgaacaaactcgtcagcactttgtgactacatttattgagcatttagagggcgtagatttcaataagcgtaaaacagtgcgtatccgtaaccgctatgatgcaaacgtaccaagcgtaattggtgaagtttctcgtccaagctccgtatttgtagacgatgcaaaattcttacgcaagcatactgataagccgattaaatgggcattacccggtccaatgacaatgatagatacattatatgatgcacattacaaaagtcgtgaaaagttagcatgggaatttgccaaaattttaaatgaagaagcgaaagagctggaagcagcaggtgtagacattattcagtttgacgaacccgcgttcaatgtattctttgacgaattgaatgattggggcgtggcagcattggaacgtgcagcggaaggattaaaatgtgaaactgcggtgcatatttgttacggttatggaattaaagcaaatactgattggaaacagactctcggcagtgaatggcgacaatatgaagaaagcttcccgaaattgcaacaatcgaaaattgacattatttctttagagtgccaaaattcttgtgtacctatggaactgattgagctggtgagaggtaaaaaagtgatgcttggtgcgattgatgtagcaaccaatatcatagaaacacctgaacaagtagcggatattttgcgtaaagcactacaatttgtagacgcaaaaaatctttatccttgtactaactgcggtatggcaccgctctcacgtcaagttgcaaacagtaagctcaatgcgttaagtcaaggtgcggcaattattcgagcagaattagcaggttaatctgatatggtagaagtctctcaatttaaagatgcaatggcacaacttgcctcagcagttcatattgtgaccacaagtggtgaaacagggcagcatggttttacagcatcagccgtttgtagcgtgactgactccccacctaccttgcttgtttgtataaatagcaatgcacgtgcctatgagcattttataaaaaatagggtgctaatggtgaatactttgactgccgaacaatcttctttatcaaatgtattcgcctcacccttaagtcaagaagagcgatttgccaatgcttattggacaacattggttacaggctcaccgatgttacaggatgcactgattaattttgattgcgaaattacagatattaagcaagtcggtactcacagtattttgatttgtaaaattgtagctattaaacaaggtgataagaaagaagcgttggtatatcacaatcgttcttaccgcattcttaaatgaaatttgtaaataaatcgtaagtcttataccgtaacttataagtcgataagttacggtgttaatttgaaaaaatcgctatgattttattaactttcttagaaaatatttgaaacgattgtatgtacgtctataaagtaattgttctcttttttgatgtttaaccaatagttgactgttatgtagttctttttctaatagagctagtgagaagagttggtaactttgttctaaatattgcattgcttccaatttatattgccttcttctatttaacttgaaatcagacaatgtagtattcggcatttgagtataagataatattttatgtaaagggattaattctaaattgaataaaaatgagatagttttgggcaaataaacagaatgtttattttgttgtaattcatagttaccaatcccaaaatctgctttcataaattttaagtgataataggcgaaaatattttttctcatatttctttgactgatgtctaaaaattctgtttccttgttttttttaaaaatgctatcttcatctaccctaaataaacatagatcaccatataatccacaataaggcgagctgtaagaaatataaagttcaccacaatgatcaataatattaattcctgaaacaggcaatacatcattgggataattttcttttaagtctagataagtctgttttagcaaaggtattttttctgcacaaagaattaaatctccgtctatttttatagcccattttttcgtagtttgactcaatgaaaagttatagtaattaaccaaactatggggattatcaggttctaaatttttatagttatcactaccttgaggataaacaataggtaaatagtgaaaagtttttattttattaggataaagttttgcgtattgttcagcaatttcaccagtgttgtcttggcaattattatagacaatcaccaattcgtctaataaaggaagccagctttcaatagattgagcaagaaactctccttcattacgtaatcgcataaaaccgcttaagccttcagaacgagtgttggcttgaaaacgtgaaaaatcaatggtaggatttttgactgactgactgactgactgactgactgactgactgactgactgactgactgactgactgactgactgactgactgactgactgactgactgactgactgactgactgactgatttagcatattgttatttcccgtctttttagagagaaaaatggtggagaatttccaccatttttcaatattattcacttctagtgactttaatcgccaactcttccaaagctttttcattagcaagactcggtgcgtcagtcattaaacaagctgcggctgttgttttcgggaatgcgataacatcacgaatattatctgttccggttaacaacatcgttaaacgatctaagccgaatgctaaacctgcatgtggaggcgtgccgaattttaaggcatcaagcaagaatccaaatttctcacgctgttgatcttcatcaatgcctaaaatatgaaatacagtttgttgcatttttggatcgaaaatacgcactgagccaccacctacttcataaccattaatgaccatatcataggcgtttgccaccgcacttgtcggatttgcttctaattgctccggtgtgaaatcttttggactagtgaatggatggtgcatcgcagctaaattaccttcttcatcacgttcaaacattgggaaatcaataacccaaagaggtttccactcatctaagtgagttaaacctaaatcacgacctagtttcaatcgtaacgctcccattgcgtcagtagcggtttgccatttgtccgctccaaagaacaaaatatcaccgctctgggcagaagtgcggtcaaaaattgctttgattttttctgtcgttaagaattttgcaattggactttgtacgccttctaatccagcgttgatgtcattaatttttacccaagctaaccctttcgcaccgtaaataccgacaaattgagtatattcgtcaatttgttttcgagtgatatttataccgtttggtacacggatgacagccacacgaccgttcgagctatttgcaggttcgctgaaaacgttgaaatctatatctttcacaatatcagctacatcgactatttctaatggattacgtaaatccggtttatctgaaccaaagcgtttcattgcctcttgccaagtcattgtcggaaatttgcctaaatcaacgcctatggtatttagccataaaccatgcaccattttttccataatttcacgcacttccggtgcagtcataaaggaagtttccacatcaatttgagtaaattccggctgacgatctgcacgcaaatcttcatcacggaaacacttcacaatttggtaatagcgatcaaaaccggacatcatcaatagttgcttaaacaactgtggtgattgcggcaaagcataaaacttgcctttatgtactcgacttggaactaaatagtctcgtgcaccttcaggcgtagccttggtaagcattggggtttcaatgtctaaaaaaccgttttcatccatataacgacgtacaaaagcggtaattttggcacgggtttttaaatgttgagccatttcaggacgacgcaaatcaagataacgatattttaaacgctgttcttctgtattattctgattaaaatctaaaggaagtacatccgaaacgttataaacagacaatgctttagctacaacttccacctcgcccgtcgccatatttttattaatttgattatccggacgagcaataacctcaccttcgattttaatacaaaattcattacgcaatgcactggcttccgtcaatgcttcttgatatttcggatcaaaacaaacttgtacaataccttcacgatcacgcatatcaataaaaattaaaccgcctagatcacgacgtttatgaacccatccgcttaatattacttgttgtccaatatggctacggttcaatgcaccgcaataatgagaacgcatcataatgacttcctttatatctgaaactactgaaattagtcgacgaattatagctgaaatctcgcttatattgaaagagcggacggaatttatttgagtgagacttaaacttcttctaaaatgaccgcacttttttacacttttttagatgaaccataaaataatgaataaagattgtatttttgctgcacccattgaaaaactgggagattttacttttgatgaaaatgtcgctgaagtattccctgatatgatacagcgttctgtccccggatattccaatatcattactgccataggcatgtttgccgaacggtttgtgacggctaactcgctagtgtatgatctggggtgttctcgtggtgcagccacgttatctgctcgtcgccatatcactcagcctaatgtaaaaattatcggcgtggataattcattaccgatggttgaacgttgtcgtcaacatattaacgcttatcagagtgatattcccgttgaaattttgtgtgatgatattcgtaatattaaaattgaaaatgcatcaatggttattttaaatttcacattacaatttgtaccgcaacaagatcgtcaattgttactggaaaaaatatatcagggacttaatcctaacggaggattggttttatcggaaaaatttcgttttgaaaataaaaaaatggacgacttgcttattgatttacaccatcaattcaagcgagccaatggttacagtgaattagaagtaagtcaaaaacgcaccgcacttgagaatgtgatgagaacggatagtatagaaacacataaagaacgcttaaagtcagcaggtttctcccaaatagaactttggtttcaatgttttaattttggttctatggtggcgataaaataacaaaaaaacagcctctgaagtaagaggctgactaagtttaactatgactttcataagcgagtagcgtattaaacataagcatcgcaacagtcatcggaccaacacctcccggaactggagtaatgaaacttgcctttttgctcgcttcatcatattgcacgtcaccgactaacttgccatcaactcggttaattccaacatcaataacaattgcaccttctttaatccattccccagggataatgtgcggcttacctactgcaacaactagaatatccgcttggtgcacatgacttttcaaatctttagtaaaacgatgagtaactgtaactgtacagccggctaacagtaattccagtgccatagggcgaccaacaatatttgaagctcctacaataacagcatgttgtccgtacagatcaacgcccgtggtttccagtaatttcattatacctaaaggtgtacaagcacgtaaggttggaatacgctgacaaaggcgcccaacattatacggatgaaaaccatcgacatcttttgttggggaaatatgttcaatcactttagtagaattaattttctttggtaatggcaattgcaccaaaataccatcaatttgcggatcttgattgagttgttcgatgagagttaataattcttgttcagttgtttctgccggtaaatcataagattttgaatagataccgagttcctcacaacttctacgtttacttcccacataaacctgagaggcaggatcagcaccaactaaaataacagctagtcccggtgctcttttcccttgttgaagataatgctgaattttttcagcaacattaaatttaatgtttttagagagttcagtacctgaaataatttgtgcgggcattaattctttccttcaaatttgatctcaaatgagcaacataacaatcatttaaattattgaacatgaaaaacgttgctattgtgtcaaaaaaaagcgagaaatgtaagtcaatttgagagaaatttcatcaatcaaataaaaaagtgaaaaagtaattgactgtttatgaaagaaaattataatgcacctcatcggcgagtagcgcagcttggtagcgcaactggtttgggaccagtgggtcgtaggttcaaatcctatctcgccgaccatttttatatttattattttttatatgcgcccttagctcagctggatagagcaacggccttctaagccgtaggtcattggttcgaatccaatagggcgtgccatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccatatttcctccaaaaaataaaccctagcggtggctatggttgttttaaataatctactagtcgctccccaatccatcgcattacagggactgccattgagttaccgatagctttataacgtggactatcggggcaatcatcaatcggtttgttgcgatatgggattggtgtccaattatcaggaaaaccctgcaatctctcgcattcggttggagtgagcttgcgaataatagatggttggcaaatgcaaggtacattatttccacctgtccccattcttgcttttaatgttggtgatattggtttatctgcaattcgcacagcctcttcgcctttgacttcgaataacaccttatactgtgatgcagtcattgtaggtgcgataccaattcctacagtgtgatccttgtctttgcaaattattgatggatacgctccataagagcattcaccaatatttttggcagaacttttctcctcttcttggctctgattaaaatcccctcgcaagctcttttgctcaaggagtatttgtgcgacacttcgccttctagcacttgccacaaggaacactcttttacgtcgttgggcaacgccgaagtattgagcattgaggactcgccaacagatagtacgggctgaatgcacataaccagagtttgtccatcttgcccctgatggctgtaatggctgacattcttgagccagtccagccaaaaggtgtccgaatgcgttgtccttggtagataagacaccttgtacattttcccagacgagcacgcaaggcggttgtccattttgatttctgacataatctattgcctctaaaatatggattaaagctaaagttaaatttcctctctcgtcatcaaggctttctcgcttgcccgcaaccgaaaatgcttggcaaggtgtacccccaactaacacgtcaggggctttgatttcacgatttaggattttttcaggcaaggcggtcatatcgcctagatttgggatttcagggtatcgataagcaagtaaagcggacgggaaaggttcaatttcagcaaaccataaaggcttgcctaagccttgccacgccacacttgctgcttcaattcctgaacaaattgagccgtaggtgaacattgttacttcaataaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaataacctagcattcccgaacacatagacgtcgtcacgcacatgagcgtagccacgaacattagcattctctgttatccacgcacagtcacttataatagcgtcttcatagacttctgcgttatctcgtacgtaggtgtcatcacgtacaaccgcgttgtcatataccaaagccttgtcacataccacggcgttaccatgtattctagcgttaccgaatactctcgcattgccatacacytymgcattgtcrkacacccamgcrtyyccgtcrtgacttagattttcctctttctcaatrtaaccgcccagcttacccgcctttatatcaccaaaagagattaatgctttaattcggtagagtgttttaccattctgttgaatagtatcattttgaagaagttcgtattttttttgatcttgtttttcatattaaatttccttgtttgttaacgtcgtttgtcggattaattttttcaatcaactcatttccgaaataagctgatcgtagtatttttgtgcggcacttacgcgttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaattgtgccttgatcactttttctatagcttgttgtcttgtttcgataatatccatcatcgcaccgctcccaagtgcgatatggtaatcttcgctattgtctaactcatcataaaattggctgtaaatttggctgtttggatcttgtagttccatcaaaacttcggtacgcactcgtttaaattccaaactatcctcaatgtcttcaccaaaatatgcttctgccatatggtcaaaatgtctatctaccgcttggattaattgcatatcgttcattttttctttccttttaaaagtagcgtttttaatttttcaatagaggctaagtcaaaggttaatacgctgtgatgtcttgtttggcgatctaacttaatagataaattaccctcttcatcaaattgacaatgttgaaccttgtgtattgttttacctcgctcgctcttgattaccgcacttaaccttggatttttccattcaatagccgtaacgccctgtttctcctgaagcataggttgtttctttatcccttttaattcttttgtcatattgatgatgtcgattgctttgtttgtcgctttaatggcgatgatttcgctcaccatcggcttgcaagtgcggtactctctcacatcatctacccaaacttccccataaaattttttactgattggattttgtaaaatttggattttgtagctattcatcttcatttcccctccttgtcatactgtgcttgtagttgttcggtgtatttttgcatgtagtctacatcggcttgggtaggcggtggcggtatrtcgcccttgcgtgaaatccattcaattcttgccatttcttcatcgtaagcaagttgtgcttcgggggagagttgtccgtattgagcaaacgctgggtgaaaataggcaaagacaagtagagtgctaagaaaaatagccacgataagaacgataaagccaagccatctgtaaaatgagattaataaattattcattttttgtttcctttttggtcaatttactgaatttaggttgagtgaaaccgccacactggaaaagtgcggtcggtttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttagattttatttgtattaaacaagccactttcgacagtggcgtcgggaggttcgaaaacccgcaataaggcaagggctggacgtatttcctttcggtattgtattagtcgccctcccgacatagtcaggattacggatataaaaaaatcgcctagtggcgattagtaaactatccgccttattgcattaggtttcgacacctatgggcgaatagtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatcccgactttctgttgaaagtgggtatatcctaaatcaaagggcggtggtttgtcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtgcggttatcttaatccgaagtggggcggttgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcggttactctcttgtgcctcactatgcacgcccagatttcacctaaacctattattgggctatgtctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttaatccgaatgaaaaacaaagtcaatcgcagaatgcgaggattttagctcatttaaaaaatggtgggagaataacttcgcttgaagcgttaaatcaatttggctgtttgcgtttatctgctcgaattaaggatttacgtgattgtggtcacgaaatccatgcagaatttattgaagtgtctagtggcaaacgtgtgaaacagtattttatggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaaaaagatttaactaacgttaaatccaaaaaagccacaccaaaaccgaccgcacttgctttgcttgctgaatttggcattaccgatcagcttgctgaagattttattgaacagcgtaaagtcaagaaagcaccgattacccaaaccgttcttaaccgcttgcagactcaagccgatattgccaaattgccacttgtggaggtagtggcgattatgattgaccgcaactggactggctttaatgccaattgggattggaggggcgaaagccaattttcaggtaaagccgatccatcaagcaagcctaaattcagcgatgaaaacactacttggtggcaagggcgaaccattgaaatttatggagatacgctgtgaaaaccattgaaaatgcgaccgcacttattggcagtaacccgaattattctgcacctgtaacacaagggcaaaaacaggaaattcctgagcaagtagcgaagtatgttgaccgattatttgttcgtttaaaagccatttttccgggctggaaagcagcgtttaactctgatgcagagtacgaggaagcgaaggctacttggttgcaagcattggtgaataatgggattaccaaagcagaattatttaaacgtggtttgcagttagcagaacgctcagaaagtccatttttgccgagtgtcgggcaatttatttcttggtgtaaatcaggcaatgagtttgccgatgttggtttgcctagtccagaagagttgttgcaacgctatcacaaatttcgtgcgagttgtgaggagccggagaattatccttggcaaagtgcggcagaatttcacttagtttgtcagttaaaacgggcgatttatcaggagaatttaacccatgagaagttactgaacaaagctcagtcgttgattaaagccatggcaaaatatctcaaagaaggcggtcaattagcagcaccaaaggcaaaaaaattaaccgcaccgaaagaacaggttttatcccctgaagaatgtgcaaaagcctttgccgagatacgcaagcagttgtctagcgttacaaaaacggtttagtaggagatgataaaatgagttttgacaaagacgcttaccgcacgccaagttatgtttttaaatggctagaacgtttgttttactggttccatttagacggctgtgcgaatgaacataatgccatgtgccatcgttggattggcaaaggtagtcacattgcagaagattttctggcagatgatttacttgatcgcttgattgatgaagtggttgaacagggggaactcttgcgaattttcgttaatccaccatacagtaatcctttgccgtttgtacaacgtgcggtagagctgatgaaagcgggttaccttgttgttatgttgttaccggcggataaatcgactaagtggtacaaagtcattcaggataatgcaacggaagttatcgatattatcggcggtcgaattaactttattcatcctgaaacaggtgaggaagtcaaaggcaataacaaaggctcaatggtggcagtgttcgatccgtttattcaaggatttgtaactcgtcaagtgagcttggattttgtgaaggagtgcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagttattcccctttcgggtgttgtattcctcgcactgtcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattaaggcggttaaagagcggttgaaaagtcgatctgagcgtttaaaagagttgcaaggtgtatttaatcagtttatccgcttgcgagataaggatttaccttgtatttcatgtggtcgctatcatcaagggcaatggcacgctgggcattatcgtagtgttggtgcttgtcctgaattgcgatttgatgagatgaacgtccataagcaatgttctgtttgtaacaattataaaagcggtaatttgacggaatatcgtctcaatttgatcagaaaaattggcgaagaagaagttgaacgattggatagaaaagatcatccgccattaaaactctcagttgatgagattaagacgttaattaaggtttataaggcgaaggtaagggagttacagaatgcagcataatctacatgattttaagaaaaaatgcagacaatggggatattgggcaacacctagaattggtacggaatatccgagtatatcaccgtcaattccggttccgcaggataaatattgtggtaaagtcgatccaattaatgaagatcttgcaatggagtttgaacgttgtgtgttaattatgcaaaaggtaactcgagaactttacgatgttttcatggtgacttatgtttatcgcttgccgttgaggaatgaatatgacaggcggagaattttggtgagaaaagggatatgtgaaaccttggatataagcgaaacaacgtataaaaaatatttgtacacggctgaaatatcattaaagcttatgttaagtcaaaataggtgtatttttgttgcataaacctccctcaaggcggtttattctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttgcaaaggtcgccctaaaagtgtagtatttcagctatggtgcggttaagtacacttacagcataaacaaacgttttttacagccctgagcagacatgctcggggcttttttatgggatttttttggtaatttattatgaaagatatggggacgcaaagttatttgtggtcgggtctaagtgggtttatcgcttggctgggcgaccagcaaaatttgatgatgataagcctttctatcgggattgttaccgcttgtgtaaatctatatcaacggtacaaggaaagtaaacttcgtaagcgtgaaaacgaacgagcggaagaattacatcgacttaaaatggcaagattacaaaaaggattagatgatgagtaagttggttaaagttggtggcatttgttcggtgtctgccattattgccttgatgatgttgaattttgctgacaattttcgcacaagccaacaagggcttgagttaataggacaggtagaaggctgtcgccgtaacccttatcattgcccttctgatgtgcttactgtaggaattgggagtactgtggcaagtagcggggcaattgaaccgcataagcgttattcagatgcagaaattgcaaagcgttgggtaaacgatattcaagcggcagaacgttgtgtaaatcagttcgctaacggtcggctaatgcctcaatctgtttttgattcagtggtttcaattacgtttaatgttgggtgcggtaagttatctcgctcgaccatgtttcgtcaagcaaatgaaaaagattggagaggtgtttgtaatgaatttccaaaatgggtttatgcaggcggtaagcgattacgaggacttgaaatacgtagagagaaagagaaagcgttatgtttgtctggggtaaagcaactttaattgtgttattgggtattttgggcttgggtgttgcaatgtgggttcaggtacagcggattgatagcttaaaagccgacaacgcttctcaagcccaacttattattcgactgactgaacagctgaagatggagcaacaggcagtgcaaatacagcaagagatagccaataaatttaaagtaaagatggagcaaagcaatgaacagcttaaaaacaccttgcaacaagagacctgtgcaaaagtggcattgcctcgtgatgttatcagtattattaaccagttgcacaactccaccgcaaattgaatatctttctccgccccttgcctatactattccttgtgaacgttctgcttttcaggggaaaacttatggtgatgcaattaagcatttaatcaaagtaatggctgaacgggatttatgtgcaagtcagattgataagattcgggaatggcagattgagaatgcacagcattgagattttaatgttaatggtttaattatggcgaaaaaaaactggaaagcgttgcaaattgaatatctaaaagcaaatgccaaaacaggtattactgttaaagattggtgcgagaagaaaggattaaagtttgccagtgcgaaacgttatataaaaaagcctgaaaccatgtttaatcagtctgaaagccgccaaacagtacgtaaagaaaaacaagcagaagcaataattcatcaagaaaactgcgaattaaattgcgaaacggacgaaaaaactgcgaaacgaaaacaacgctcttatgtgaattcgcagaccgctcgaaagcatggtggttatgctcgctatttcaaagacaaatctgcctttgatgttgtagtggattttagccttaaagatgaaattgatttaatgcgacagcgtgcggtcagtgcggttgaaagtatagaaaaattcaccgcacttttagccaatgccaacaccgcagaggaaaaatcactttatgcgaagctgattgagtccactgacaaagcacttgaaagagcggtcggtcgcattgagaatttaaatcacacggacaataacattgcaaatctcttaagccaaattgaattacgtaaggttcagtctaagaaagtaatggcggaaacagaaaaacttaagcaagagatgaatgcgaaaacagcgggacatcataagctcgaataccttcaggagtttaactaatgcgtattgtttatcgtgcttcagaaacgtttaaaaaagtacatgcctcaactgcgttggttaaagccattcgtggacctatcggtagcggtaagtccgtggggtgtgtgttggaaatgtttcgtgttgcacaacagcaagagccgaatgcacaaggcgtgcgaaaaactcgctgggcttgtgtgcgaaacacctatcctgaattaaagggaacggtgattaaaacctttcaaacgtggatacccgagcaaatttgcccgattaaatacgatagtccgattacaggtaagatgaatattaatcatcctgatgggaaaacacgtattgaagcggagtttttgtttctttcgatggataagccaaaagatgtgaagaaactaatgtcattggaattaactggtatttggatcaatgaagcacaatttttacccgtttcactggtaacagaagcggttacacgtaccggtcgttatcctgaaaagcgggttgaagaagggtttatgggggcgacgtggaacggtatgattatggatactaactcgcccgatgatgaccattggtggtatcagtttgaacaagggattgatgaggaaactgaacagcctttaaagcctaaaggttgggagttttttgttcaacccggtgcattaattgatattacaggcatgcctttagcgacattgtctgatgagataaaacgcaatattgaacaaggacattatgatgattatttaggacatcgttttgtggcaaatcccatcgcagaaaatgttattaatcacaaaaaagggcatgggtactggtttgataatattcaggggcaaacattaaactggatcaaatctcgagtgtgtaatgaatttgcaaccgttcaacaaggcaaacctgtttttggcgatcacttcaataaagaattacacgtttcaacagaaaaactggtaccagtcaaaggttgggaaacctttatcgggttggattttggtttaacacctgcggcgattatcggacaaattgcacccatcggacagttgcggattgtagatgaaattgtcgcaacaggtatggggattgagcgttttattacggagcaattgtcgccattgttaagaagccgatatgcagagtgtgctattcaaattataggcgatcctgcaggtgttcagcgagcacaaaccgatgaacgcacatgttttcagctgcttgaggaatacggttttaatgctcgtccagcagaaagtaataatacgacagcaagacttgaagcagtgcgttggtggttatcccgtttagtaggtaaaggtcagccggcaatgttgattagtccgcactgtaaaacattgattaaaggatatgaaaccggctatgcctatcgtcaattgaatgtgagcggtgaggaaaaatatactgaaacaccggataaaaatcggtattcacatccgcatgatgccaatcaatatctttgtttaggtgcaatgcctagcctttttaaagagcaggttatcaatattaaaacacatcaaccactaagcaatattacaggatattaacatgtcagaacaacttgcaaacgccattgaaagctatggacgaacacttcaaggcattttacaggagcaaattaaacaacgtcagcccatcgtgcaacgttggacgaaagatatgtatcaataccgcaatcaatatgaaagtagtgttgacacagggaaatctaaagtctttgtgggatatacgagagcaaaaaccgatgcgtggtcggctcagatgacagatatgttatttccaagtgatgacaaaaactatggtatttcgccaacgccagtaccgcaaattgctcatcttgctaaacagcccgacagccaagatccaatgcaaatgcaacaaatcaacatggcaaaagagctaatgcaacaagccaaagagcggtcggaagctatggaaaaattgattgatgaccaattggcagaatgtgactatgcctctgaggctcgccttgccttgcattacgccgctgtacttggaacgggtattttgcgaggtccggtagtagatacaattgatgagcgtatttggtctgatgatggaatgggtaattggtccgcacaaaccaagtctaaaatagtgcctaaagtgcggttagtgttaccttgggattttgtgccggatatgaccgcacctacattaaaagactgccaatttgtctttgaacgttcttacctcactaaaaaacaattgcaaaatctgctgaataacccttattacttagccgatacggtgcaagccttaatcgaaagcgaggcaagcgaaacgcatacctccagcagtgatatggacggttatttagacacccttcgaaccttatccggtttagaaaaagcaagtaatgataaacggtatgaggtatggacttatcatggtggcattcctgtttctgtcttagagcaagctaatcaatctttagaagaaggctatgcgttggaattaacggaagagcaaaaatccgaaaaagcggaaattgacggcgtgattgtaatgaccggtaatggcaagattttaagtgtgaatcttaatccgcttgataccgcagagtttccttattcggtgtatacatgtgaacctgatgtcgcttgtgtatttggtttcggtattccttatttgtgtcgtgatgcacaggaaattcttaatactgcttggcgaggaatgatagacaatggtgtgttaacgattggatcgcaaattgtcgtcaatagttccgtactttcacctgtcgacaaaagctgggaaattaaaccgaataaattatggcgaaccaatgatagagtttctgctaatgcaagttttgaagctcaacgagcttttggcgtgtttaattttgaaagcagacaacaagaattggcgaatattatccaactggcgaaatcctttatggacgaggaaagcggtttgccaatgattgcacaaggtgaacaaggtcaagttacgcctacattgggtggcatgtcaatgctaatgaatgctgctaatgcggtacgcagaagacaagtgaaagaatgggacgaccaagtgaccaaaccgcttatccgccgtttctatgaatataatatggcgatgaatgacgacccgaacatcaaaggcgatatgcaagtagtggcaagagggacgtccgccttgttggtcaaagaaacacaaacggcacagattattgatattttccaaaaattcggcaatcaccctcaattgtcttatgcgttcgattggtatgacggggcaaagaccttaatgcaatccatgagtatgggggcgaaaacgatgctgttatcaagggaagattatgagcagaagctccagcagatagaacaagcgaatgcgacgcaaccgcaagatccggaaattctcaaatctcaaatgcaaatgcagttagcacaaaaaaagcaacagcatgaaatgcagcttgaacagatgaaattgcaacatgccatgcaaattgagcaaatgaaagtagccatcaaagagaaagagcttgaagtaaaaatgatggaaattgaaatgcgacaacatcaagagcaagaaagaatatcacttgatgaacgtatcaacagtgtcaaagtctcttccgatatgcaacgagaaaccagcaagcaaatgttagatatgaagaaattccaagcggaaattgctttaaaacaacaacctctcgccaatccaacaggaaactatggtgtagagtaatcattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaccagaccgccaaaagagcggtctttttttgttcatttttaaggaagcaccatgtcaaactttagtctttccaatgaagaatttcagtatttgcaaaaaaacatattaggtatcgcaccaaatgcaacaggttcaagaggacgaggacaatcggatgttgcagatgagggttcttcgtccattgatgtcatagctaaccaatacaaattgccggaagagcaaggtttttttgccgatgtggttgatagcgttcaaatgggggcatggcgtggagcaggtgatttagcccgaggtataggagctttatttaacagtgaatggttaaacaaagcggctgattatgcctattacaacgcagaagaaaacaaagcgaccatgtcaagcaaaatgcaagaagccttgggacagagtgcatttgacggctggaatgaagaaactggagaaggcaaaggtttactcaatatgtattggtgggcgggcaatttgggagcattgctcggtgaaaatattgatacggttctcaccatgggagcgggtaaacttgcgacaacaggaataaaagcaggcggtaaacttgccggaaaatatttcagcaaagaagtcgcagaccaagtagggaaagcagcggtaaaacaagcaagccgtttcggtattcccgctcaatatcataaaaccattgcctacacggcgatcgcctctgctatgtcggcgggtaatcgtgcaaatcaagtccgagaggaattatcgcaaattagcgataatgacctagctcaacataatgactttcgtattgcgtattgggatttaaaagagagtgatgaagggcaaacactttccgaccatgaaatttttgaacaagcaagacagcagtattacaacaaggtcggacgagatgcgatactcaatcctcttgcaattgccgcagatattactgctaatgctgttggtggtttagggggtggtctttggggtctaccaaaggtaaataaatggctgggcaaaccgacacaaagtgtcaaagagggtgtattaaaaggggcatttattgaatctgcaacggaaggcttacaaggtgcggctgaacaatatgccatcaatgacacagcaagagattattacgatagtgaccgcagtttaactgagggcatgagtgaaaatattgctgatggcatggtattaggtgcagggttcgggggcttgacaggtggctatgaagctatgtctcatcgcagaaccatgaaccgagaaaaaaaacgccttttagaagcggtgaatacgggtgatgaacgagtggatgcacaaattcgttatcaagtagaagcctataacaaaattgccaatgatttagatgaactgatttcgccacaaagaatacaaacattaaatcaatttggcttacaagcggttgaaaaagcaagacgtagagaacaaattgaagcggaattaagaggggaaacacaagctcaagcagaaaaacaacaagcagagcaagttcaaacagtaactgatacaccttaccatcaacgcaatttagccgatattcaggcggaatttatccagcatggtttagatgaaaatgattttaatgattttctagaagccaacttgcaacaagcgacagcagatttacaaaaacttcaagcaaacccatttaaaatggggacagatttgcaaaaaagtttagcggaaaagcaagcctataatgcaaaactggcggacacacaagcaagagtagactactggacacaggcaaaaaccgccccaaagtttggtactgaggctactcaagcagaaagtgcggttcaagcagagagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaatagaaaaaggcaacttgttagaaatgacctctcgcgtatcaactgcggagatttctagctcatcgcctttatctagtatcaatgataaacgccttttgcagattttgcaacaacagactaaatctttcgactttagccaagaaaaatcccaaattgcagaagctgtaggaaaaggactatcaaccgcattttgaggtggtgcattcttctgaactaggtattaacgacccgactattgaagcagcttacaatacccaaacaggtaagattgttattattgcagacaatattcgagccaatgacattttaacacgtgaagagcgtttaaaatgggtagcgtggcatgagctggcacaccgaggactacaagtgcggtatggaaaagacttccaagccttgatggaacaagcagaccgaaatacgacagtgcgagatttagcaaccgcacttcaaaaagaccgtgtagaacttcgaaataatcgtactttggcggtagaagaagcgatagcggaactgcacgctgcttataccacaggcaaaatggaagagttaaaaagccgttatggtctagttgttcctcgtggtagagaaataagcctaaaatcttggtttagaattaccgcagaacgcattcgagcgtttatggtaaaacttttcggacgtgaaaaagcaaatcgttttagtcatgatgagttgcttaatttgttgaaagacattcagcaaagtgcgggcggcgatatacacgaagcggataataatacacgctattccttaaatgaagatccaaattctgattttgctaatgccataccaaaacgcacggcgactagctatgatgaagctcgttctattgtatctgaattactaggtgaacctttagtaaataaagaaacaggaatggtagcgaccatttcaagacgctctttagataagttgctaagtggtaaagcggtagataaatcaactaatctgaaagatcatttgacagctgtcgcgaatatcgatcaattatttgaaaatgcaattcaaggttgggttgaagcagataagaataacgatcctaacatagcaggagtgcatagattatttgcaccattaagtatagatggtcaaattagactagcaaaactaactgtaaaagcgatgagtttcaatcaaggaaatcgagtttattcggtggaaacgattgaagtagaaaataaaaatagcgatttgtctttatcttggaagccacagctaagtgaaaacactcaactgacttcccaacaaatcgctaatgtccaaagtttaatccaacgcattcaaaaattcaatagtggcgatcaaacttatcgcttttcacgttcaagcacttatcaatcaggcgataatatttccgtattagaactttctcgtggtggaaatattcaagcaccaaaatggacggataagttcagcacgcttcaagccttgaaagaaacttttcatcaaggaacggcaaaattggacgaatggtttgctgatagcttaagaccggtaaatgattggatagacaacatgcagtttagcgatcataccagtaataaaagtggtcgagaccatgaaaaacgccgtttaaaagacgcaatgtatacagcaaaaggaagacgtgatgccttaaattctgagtttgaggttcattatttgaatccgattttgtcgaaaattgcagaaattgctaaacggtcgcagggtaaaatcaacgaagaaacggcaaaaagaaaagccggcttttgggtttcagcacgttattccattgaaaagaatatggagctattgagcattgatgaaaaagctatgcaagaagcacaaacggcgttaaatgaggctcaagtcaacggaacggctgaagatattcgcaaggcaaaaaatgcctttaattcagcggaaaaacactatcttgaccgtaaagcggcagtatggaataaagactttaacaacaagcactttaaagcaggagttgccggcggttggtctattcctgaagccaaagaaattatgcgtaatattgagcgtgatatttcgcttagggatttaacggcaattggtgatttaattgcggagttaaaccaagcacggttagaaattgattataagagcggtcgcttaacagacactgaatatcagcaatttaaagcgaaccgtcattatgtgccgttgacaggcgatccgaatgcacaattagacgacatggattttatcgcaggtgctggggcaaattcgttgaatattgccaaggataaaaccttaaaagggcggacaaattctgaggcggaagatgctattgacgcaatttggaaagcggtagggaaatcgacgacttatgcagggtggtctgaatttaaagggaaacttgatgcgttgcttgaaacggaagtgagtttgcttgaacagcaaggctatagcaatgtggaagcacaacgcctagccggtcaaaatttagggattggcaaacaaaaaatgcaaggactgacacgcagtagcgataatgtgttaattgcgagacgtggaggtgtgtattatgagtacagtttgccgaataacgtcattgctgccctgaaaaatgataatgtggaacaagcaaatgattttcttaacgtcttatctaaacctacccgttggtatgcaagaggagtaacgcagtggtcattggcatttgctccgattaatatgctgagggatacatgggaaaaatccgaatttattcgtgtgcaaaaagtatatgacagacaaggtaaattgctcagtagcgataaaatggatcaaatcggaagagcgactgcactttcacccctaacaaatcctgctatttgggcagcaacgaaacgctttgcttttgggcaagaattgcgtgatagtgtgttagaagaaaagctattgaaacagctactcaaagagggggcgatttcaacatatggtacttatctcgaacgcacagaagcggatttactcaaacgcattaagcgagaaaatagcgtgctggggagtaaaatagacaaggcaatgggcgtgattgaaagttataatcaaactttcgatatggtttccgcactttctgcttacaaggcgttagtggataatggcgttgatagtaaacaagcagccgcaacaacattagaactgactaactttcgtaagacaggttcgaaaatgcgaggtattaaagccttgtatatgttctctcaacctacagtcatgggagcggcgaacttaattcgttatctttcaacgaagaaagggcaaatacgttttctgacgtataccgcaggaatgatggcactttatagtctcttgcgttctatggatgatgaggacgaggcggggaataaaatggatcagctgggtgatattacacgttttatccctattccaataggcaatggaaattatattaaacttcctgtggggtttggtatgcctcaaatggcgtggaattttgccacaaatattgtgaaaggtgcggtgtctgatatttcctttatggaggcaggcgtgaatatggttacccatgccacaaaaacctttgcaccggtttcgccatcggaaatttccgcattgaaatacccgttggaaaaattagccttaacctttacgccgagcattttacaaccgcttatgcaaaatgcgttaaatcgttctgcttttggtagtcaaatcacgacaaattttgttcgccaagacaaactcaaggctgaacaatccaagtcgacgaccgcacaattttggaaggatttagcgattgatattcaacaaaccttaggtcttgatatgcaccctgaacaaattaagaatttgtttgatggatatagtggtatgttaggttcattgaaggagctgaatacgtggcttgtggaaaatccgaaccgtgagcaattggggcgtaacacgagaacattgttcattaatcagttgtatggtgcaggtaatgaatttgcggtgcaatctcgttattatgaagcgagcgaagaagcacaacaagttgctaaggagtatgcttatcgaaaactcaataaacaattggatagggaatggctaacgcctgaacgccaagagttaatcaaatggcatgagtataacttgcgaaccatgggcaaattacgcagtgaaaaggcacaactcaccaaacagttaagagcgggaaaaattagtgcacatgcttatgagcaacgcctcaaacgctacaatgaagcggtaaactcggtacagaaaaaactgctgtcaggttatcgccaaatggtagggttaagcagttattgacctgtaaaaaaagcaaataaagcctgtgttaaacaggctttttcggcgtgtaataatgacttgctcatttctttttaatagattaaaatctataaaaaagataaataggcaatgtaatgcaacaagagtggaatgtgattttgcaagatcctgttttggagtggtttaaaacgctaaaacaagaggatttataaaacgatgatagcccttgctgaacaaacttatgaacactacctttcacaattagagcaggagtagcaaaatgagcaaaaactttaaagcattgatggcagaattaccgccggaacaacagaacaaggtgaaagaaatggctcaagaaatgagaatggagctacaactttatcgtattcgtgaagtgctggaaatctcacaacaacaaatcgcacaagcaatgaatatcaaacaaccctcagttgttgctttggagaaacgaggaaatgatgtgcggctttcatcggtgaaacgttatgtggaagccatgggtggagtgttgaatttatctgttcaacttccaacaggaaagacaatctcttttaacttgtagcattcataaagcgacataagatatagttgcctgatattttgcagaaattgccgagttatattttcaatgtaactcggttttttattggggaaaaacatgattaatttgtccagtgagcttgaaaaagagcaattaaacactttttttactcggcgagtaaaagaatatcaacaagatttaagtaacgagggattaaatgcccagcaatataatattttgcgagggcaaattaaagaattgcaggaattaatcgctttactaaatattcattcaaactgaacctacccaccaagtgcggtaggttttttatttttaaccattcaataagccgctttatgccgctttaggagaaaacaatggaaaatcaagaacaccaagagttcaacgaagatgccgcttttgatgaagccgcgaaatcgctcgaaacaggtgaactgactgctgacagtttgccatctgatgccgagaaaaccgaaaaggacaagcctgatcagcttgaatccgaacctgaacaacaagaaaaggttgaacaggacgatttgcccgattggttgcaatctgccacagatgaagtgaaagagaatttccgcaaattgcaagcagataaccaacgttaccaacatcaagcccgttcacaaaatgggcgtgttggggcgttgacaaagaaatatcagcaagcacaagctgaaatcgaacgcttaaaacaagagcattcatatgcaaaaccgcagttaaatgatgagttaaaggcgttagaagatgactatcctgaatttgctaaaatgttccgcaaatttgccgaacatcaagatagacagcttgctgaatatactcgaccgcttgaacagctagcacaagccgaaatgcaagatcttgctcaacaacaactggagaacagtatcaactatgttagccaaattgtgcctgatgcggagcaaattttaaacaatccgcattttgctacatggttacaacgccagccagtaggtattcaagccttgttcaattctgatgaagtggatgacgctatttatctgttgagtgaatacaaaaaaaacatttccgcaaatgaagttcgtaaagcaaaacaaaatcagcaactctccgccctttctttaccaagtgggcgaaccgttcctaaaggtggggaagaggtggacgaggatgtttatttcaatcagatcgccgcacaacttgacaagcagcggtcacgttattagttcatcttaaaagaggaaaaattttatgactacaatgacaaaatattctgacattagcccacgtactacagtgtatgcagcagctcaaatgcttaatcatgcagagccgattttggtgttaaacaaattggggcaaactaagcctattccaaaaaacaaaagtcaaaccatcaaattccgtcgtcctaagccatttgctaccgcacttgctgcattaacggaaggtgtacgccctactcagcaaaaaatggcgtatgaagatgtcgaggtgtccttgaaacaatatggtgcatggacggaaattaccgatgtgattgaagatacacacgaagatccggtgttaaaagacattactatgctttccggtgaacaagcggcggaaactgccgaaatgttgacatggggtattttgaaagcgggaacgaatgtcatttattcaaccggtacagcgacgagtgaggtaaaagatgtattaagcattaatcacattcgtgctgcggtgcgtaaattacagaaaaaccgtgcgaagaaaaaaacctccattttagatgcgtctattaaatatggtacgaaaccgattgaggcatcttatattgcggtttgtcatactgacttggaggcggatattcgtgcacttgccggttttacaccggtggctgaatatggttctcgttcaccgattgttccgcaagagtttggtacggtagaaaatattcgtttcattacctcgccattgtttaccccacaagaagatgcgggagaacagtcaagcgatgtagtatcgaaaagcggttcaaaagctgacgtgtataacattgttatctttggtcaagacgcctttgctacctgtccgttaaaaggcaaggaatcggcagatatgctgattcgcaatccgggtaaacctgaaaaaggcgatgagttagggcaaaccggctcggtgggttggaaaatgtggtgggcaggaaaagtcctcaatgaggcttggctcgtccgtattgaatgtgccgctaaaaaactttaacccaattatcacaagtagccccatgtaaaagtggggctttattctttatgaggaaattattatgtcttatccatttatttcatttaattcgacagtagaacaattaaaaacacatttacgtgaacactgcggtattgaaaaaagcggtagcaaaaaagaactgattgaagcaattttagcgtttgaagaggaaaacggattcgtgcgtccaaataaagacgtggcagagcataccgctcctgtgaataaccttgaattacctttagaaaagcaacgaaaagtgcggattaaaattgcagaaaccgagcaagatcgcagtgatgtttatgtctctattaacgattgggacgcattgattaaaagagggatagaggttgctgtacctgaggcggtgtatgttttattatcaaaagctggcgatcaaacctttaagcaagaaaaagacggctcactgacggaaggtttcagtcctcgctatcatgtgactttattgggttatgaatcatgaattttttagcgttggctcaacgtttacgccaagaaatgaatgattcaggtgaaggacctgcacaagtaacgggacaacgagggcgaaatttagagtatgttaacgccataagagaagcatggcttgatatacaacaatgtcgcccttgggcggttcagttttggcaacaaggctttagccctgataaattacagatacttgaaaacactgttgatacgccgttcattcctgcacaatatcatcttgcaatcgtattttatgcgatgcaatccaaagccatttcacaaaatgcacaagaattgatattgcgaggacagcaagaatgggacaaatatctccatttactttgtcgggactttttgccgacgttgaaagtaggtaggtagacaagctatgttgattattttagaatagccatattattccattttatttgaggtttttatgtcaaatcctaatgctccctacattcgggaaattgttgatcgctcacgcctaattggtggaacagcgatccaatctcaacggaaagatgacgtaaaaaaagccgttttacaggtattttctcaacaggctyaacgcttaaactaatttgtcaaaaaaccccgacttgttcggggttttttattgcctattttcaggagttccaatgaaactaccgcaaattcaatcacagtttgttgcgataagtgggggtatggatttaaccacaccgcccattgttaaagcaaatagtgaagctattattgcgttaaatgtacaacctaattacggtggcggattttctcgtattgaggggtatgaatgtttagacggtatgactaccccctctttaatgaaccattttcatgtgaacgttaatcacgatgttccacaaagtgcggtcggaaaacagtttttgttaaatgaccgcacttgttatgtgttagcagtgaatgaacgttgtttaacctttgccgtttcgggacagtttgaggttgatgtcggtacaacctttgaccttgataggcaaacctatcaaaccatctcaaagacttttttgaatacaggagaggtcaaacaatggcaacattaccaagcactggcgtttcaagcgggagtggacaatgtgcaagcggtaccgggtgaaaatgccttgcgtggtgttgttgaacttaacgagcaaattatcgcatttcgagatggggaaaatgcttgtgaggtttttttagcgaccaaaacaggttggcaatctgcacctgccacttattttgttgagcttaaagacatcagcaagccaaacgaatttattgacggtgtgaagtttacttccggggaaaaacaaggaaacgtattttctgccgtgttgtcggctgatgatagtagcggttatcttgtggtcaatactgctcttttacctgcggcggaaattcatattaacggtagtgttgcggctaaggtgaaaagctgtgaagcggtcagattgacaaaggaaaaggcgtggacatttatttatcataatttttatggtggtacggaaacggcttatgcttacggttgtaacggtgaacaggtaattgaagttcgtcctgatggtattatcgtaccgattataacccaagcggaaaatcctcaatatattgttgcacatcgtaaccatttatttatcgccttttcagggggacaattcgggcattctttagtgggcaaacctacgcattgggcagtattgctcgggtcggaacattttggtgtaggcgatgaaatcacagcactgtcttctaccacagggggcgtactgttaatcggttgtcgccataaaaccaccgcactttatggctcaacacgtgatgactgggtattaaaagatattgccaaggtggggattaaatcaggtacgctacaagcaacctttattccgattgccattagtcgacatggtattattcgtgtcgatgcaacggagcaatttggcgattttaaattaagtgaaacagactccggtcgcaaattgggtttcaaacccattgaaaataatattgtcttttcttccacaaaagccaaagcaaaccaagtgcggttttattcggagaatgcgtttcatatttgcatgatgttacaaccggacggcagtacaaaaagcacctatttcacttatcccgaaaaactaaaaggcgtatggcaatctcatcataatacgtttttagcttttgatgacggcaaagtctatcgtcaatcggatgactgtttttcttttgcaggcaagccgattgaatggacagtgaaaatggcatttaatcactgcggttcgcctgtgcatattaagagctggaaaagtgcggagttacaagctaccgcacagggtgttttgtctgtgcaatatcgtttcgatttggattataacgctgattttcatgcagtaaatcttgcacaggcgttatccgttattggatatggtggacgttggaacgaaagttattggaacgattttttatggtcttctcaggaatacgccacacccgtactttatttatcgggttacagtcgaaacctatctttatcttttgccggttcggatttatacgcccctcaatttgaactgagcggcttagtgttaaactatattttaaggagatttcatcgtgtctaacaaactcagaaattggtacaaaagaactcatgattttgcaccctatactcgtgctgacggaaaagcggtatcagatgaatttgatgcaatccaagcgagttttgaaaaaattcccgctatgcgagatgatggcttaggttttgcggaaagccctgttattcccgacccgacacaggataaccaccctgtacccttacatttgttaaaaacggcggaacaatcggtttatgcggcgagggataaagtgacagagcttgctcaacaagttacagacaacaacgcaacaacggagcaaaatactcgtttagctattcaagccaataaacaagcccaacaagccaaaacagaggcaagccaatctgccacacaagcgattgacgccaacaaccaagctcaacaagttaaaacggcagtacaaaaagcgaaagagaccgcagtttcttcaatgcaatctgcggaacaatcaaaaaatcaagcaatacaagcggaaaatttagcgaaaaaatgggcgtccaatcctcaaaaccaaatagtacaagaggggaaatactctgcttatcattacgctctagaagcagaaaaacacgccgaaaaagtcaaagcgaccgcagagggacgtaaagattggaattttattgataatgtccctatcagcaaagatattaacgatagctcagagacaaaattagccagtgctttttcggtcaaaaccgcttatgacaaagcggttgaagcggaaaaaatagctaatggcaaaagcaattttaaaatagaacaaggcaaagacaacgcagacgactacaaaaccgacgggcactattattttgcgagcggattgaatttgcccgataacggagcgtggcatgttgaagtggtgagcggtgggcaaactaccgccgtgcgacaaattgcacgcaaagcgaacgataccggcgtcaaaactcgcttttttaatggttcaatttggacagcgtggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttcaatggaaataatattcatcatatcgccggcaatttcaaagaaaactcggtaatcgccaaccctaaaacgataggggtaacgatgattaacaagggcttttacattagaacaaaaaggaaaatgcgttaattcttggcattttcgtgcaattttcgcccctgttggaatttttcttaattgctttaacgctttgggttggaaaataaccgacttcatgaataaagaatataagttaaatataagtttattttagcaaaaacaacaaccaaggacaacacatgaaaatctacttcaaagacggcttttatatgagccacattcacaaaaatattccccaaggtgcggtggaaatctccgaagatttataccgctctttactgatgggtcaatcagaaggcaaacaaataatcacagatgaaaagggttatccgcagttagccgacccgcaacccagtccatttcatcatattgaaaaggggcagtgggttatttcgcctgaaaatcaaaccgcacatttaacccaagtgtgggcggaaatgcgagagaaaatcaatgccttgcgagatgaaaaaatcaatggcggggtgtttgtggaagcggtgggcaaatggattgatacggacgctacggcggagcggaatatcttatccgtcaaagccagttatgatttattcggtgatatggaaattgcgtggacttgtgcggataackctgttttgatgataaataaggaaaaattaatgcaaatttggcaggcgttaatgmaggctaaaacaagtaatcatgctaacgccttgaagcataaaaccgctatggagcaatcggacaatccggcggaatatgattattccagcgggtggacaaaatgctatcaggattatttaaaggagcagaatgatgagtaaattaaaatattggttttatcatgttttaattgccgttgaccaattactcaatgctgtttgtggcggtgcagcagatgaaaccttttcaagccgttgttatcgtggtgcggtattggcaaagaaaccgaaaaaacgttggcgagtgatacataagattgttgaaacgcttttcttttgggaaaagggggagcattgcaaaattgcctatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttttctacaaaaagaggacaaataatgggtattttaaattcgatgagtgaggggttgcaaaaccccaagcaaaaaccgcttgcacaaggcactgcgaccgcacaacctcaaaacattagccaaccaatgccatcaatggctcagaatgtaacgaacaaccttaacagtaattcgttattaatgaaaagtgcggcacaaaaaggcaatcgaatggcggcacaaagaggattgcaaaattcaaccataggtattgagtctgctcagcgtgcgatgcttgatgcggcgattccgatagctcaacaagatacgcaaaatcagcaacaaataaccgtagcaaacttgaacgctaaactttcacatgataacgcaatgaaagagttgggtgctcaagtgtcggcgaatacaatcggcaaatctattgattatgcaatgcaaattacaaataactttgacgctcaaattgctggtgtgctgaataatacgcaaatgaaagaggaggataagaaaaaagccattgagcaattgaaagcaagtcgagatacggaattgagttttatgagtaggtttatgcaaaaaattccgacgacacaaaaagattgggcggcattcccgtcattgggcgtaccgacaatcacaatgaaaccaacagaaacagggggtaaagtatgagtttttgggattcagcttggagcgtaattacagagtctgccaaatggatggaaaaaaaccaagcggcaacaaatttaatgggaagtgtactacaaggaactgcgggctattttcttcaaaaagagcaaaataaaaatttaatgcgacaacaacgtgaattgcttaatttgaaagatgaaatgcaatcaaaatattctgcggtgccggaagtagactcaggttatggtgggcttgtggttgatgagacacctaatttggcgaatggcggtattttaactgaaatgaaaaaaaaggtagatagaaaaggagtgtagccatgggatttataaatgatgccggcggtggtacagctagaaatattcgcgatatagatagrgacagagatagagggcgtaataatagctatgatacgcaaagtatggataatttagctaaagctattcacgacggctcttatcaaggaaaaaatgatagcagatggtctcgtcgagacaaggacggctatagttcattcggtcgagatagggataatgaaaagtatagcaactatgccggcagttattctaaaggaaaaagtgcgattggaagtgcggtacaaaaccatcgaaatgtagtagctaattctccgtccgatctcaaatcaaaaacgctaacgggtgaaaatattgatgatggtttgttgtcctcaaaccaaaataagcaatatagtccaattgactatgctgaaatgtataaaaacggacctcgtcatccgatagaaaaagcaacgttgggtaagcgagaaatgggaccgatgagccgaattgcacctgaagatccacatgctaacagctatcaaaactacagatatgtacaatccttagcgaataaggattggatagaagatacgcaacgaagcatagccggaaatgcggttggcggaatatcttcctccggagtggctaatgcggttgccggtgctgtagggggcggcttaggcagggctgtagccggagcagtagcgggaatagcagcatctaatgccggagatttggctaatatggcagtaggtaaagccaacaaagaaggattaacagatgaacaaaaagcaatgtacgatcaagctttctcacagagacaggattatttcgacaagagaagacgttcatttgatagtttcggtaatggtatagcgactgttcttggcaccggtgtcgatattgcttcaaaagggctaaccatgggggcaggctctaccatcgctgatgcctacaaaaataattcggcattggagaaaaccttggaaaattttgatagccctgaaaataggcaatttttaaaagaaagacaggaggcgtacaagcgtgcaagggaagaagatgcgaaaagacgcaaagcagatgggtcaaataaaggcattctctacaatatgactaaacgtctacagcctcaagaagagccacaagagccaactttaccttactatgctattccggcattaactaatctttggaataacgtcattgtgaaataaacaacaggagaaaactcaatgggtattttagataatatggcacaacaagccaatgcacaaccgcaaatgcaacaaacggcgacactaccacaaactgaacaaacgggaaatatgatgcaaatgtatcaattcttaatgcaaaactcaatgcaagccatcgcagaaacggcagagcaacgcattcacgaaaaaggaccggtagacggaacggcagatttaattgcaaccgcaatggtttcaaatcttcaagcggcacaacaaaatggtaaaaccatccccccacaagtcatgttacaggtcgccaaagatattgccatgcagttattacaacaaatgggcgtaccggaagagcaacttgatgatgtattgattgacgttttatttaaagcgttggatcaatttggtgaaatgagccatggcatgttatcagcggaagaagagcaacaatatgtcgacatgatcaacaaaatatctgctgcggaacaacaacgtcaagcacaaaaaggcgaaaatccgaccgcacttgaacaggcacaaacgggaggtatgtaatgggatttggcggtattttagcctcaattgctcatggattgggcggaggtatgattaaagtcgcggatgagggctggaaaaaagaagcagacgagcgtaaaaatcaattctatgcagatcaaaaagcattagatcgagaggctgaactaattctattagacagaaaacatcaaaatgacattagttttttgcataagaaaaatgcgatttctcaagcggttaacaatagccctaatatgaaagcgatgaatgaaatcaaagacgcttttgatgcaatggacgcaggaaacaaagaaattgcacgacttgatgaattattagcggataaatcactttccaaagagcaacgagaaaaacttacaacgcagagacaggcaatttacgatcatgtttcttcagtagccaacaacgaagaaatttggaaaggaattcataaaggcagatatggtcaagcaatacgcggcaaacatattcaaatgactacaccatacaaaaagacaccatctccagtggctgtttcgcaaaagcaagccaaccagcctataattgtaccaaaacctgacaaagctcagttatacggagaagatattatgaggagataccacaatggagaattactagactagcaaaaactctaaaaacaaaccgctctttggattgaattgaagagcggttagaatttattttgtaagctgtatctttgcaagatgtaatggtagttaatgagatgtgaaaatgtgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttctaagccgtaggtcattggttcgaatccaaatagggcgtgccatttcttaaattcctctaacaaccaaccaactacagctccaatgatctaaactaacaacagcttaaaaaacaagtattttttgctatctcaaaacaaagtattgtatttatatacagtataaattatgatctaaaagaaccgattacagaatttaactgttaccaaaaactgatccaaaaacaaaaaaagtgtaccaaacagcagaattaaaacccaagccatgtttaaaaaaatcacccaagcaaggcacatgaagctacgccgccaaaaagacggtatagaactagggtttagcggaaataccgcctacatcgccactattcatcaatatggattaagagcaagagtagaacgacacaaagaacacaaagtacaatacgccaagcgtgaattactaggccttacagaacgggacaaagaaatgattgaagcgtttgtgatcaacgcattgagtgaaaatattgattagatgtcatcatctaaattcttatttttgcagtggcaacaatttttatcacgattggacgtatcataaaacaacacaaagataaaaaataaagcaacactgccaaaaataaacgtcagcccaacgcttaaatcaaaataaaaataacaaataaggtaaggacacgcgacaattaacacaaaaataaggtcaataaaatcattaacagtcaatttacttttcatagaaccaccgtagtttttgtcgttattgtctttttatattaaaaaatagcaaataaccgcaataagaatgatggcacttatgccccattcaaggctaaattgataatcgacctgttctttagcatgataacgtccggatttcttttgaattgccattagcactgtatccaaaagtaacatcaaaggcgttaatgcaaacgtgaataacacgcaacctataccgacagggatagaaagcaaaaaaacggaaataagcaaggaactgaaaaaatgaatgacagataaggtttcccaactcatccttagcgaaataccaaacaacacaataacggtaaacatagcactgatgtagtacaaatgagtaacccaaaaaaaagtaaaattttcatactttaattcatcgtgtcgcataaaaacccctgtgttttttgtgtatctttgtttattttttctacgttgtcaatcttatttcaacatattaataatttgttctcgagatcggacccattcataaatcactgacaaaaatagttttggtcagcattgccggttgattatcatccatatcagcaaataatgtggcaagtttttgctgtgctgtgtcataatcatcttggtttaatgcgttgatcaccggattcaatattgggttcattaattgttgatatttctccggtgtcggttctaatccgtctaacacttcatcaggatcattttgtaccgataataacgctattttccctttgcctatcttttgaaccgacaaaagtgcggtcatatttggcggtgttttacgctctaatacagcttcgttttctgttacggtacttgcagtttattcgtataaactttgttgatgttcatcaggtctggttttaaatcggcgatgtaaccacatatattgtgttacatcttgcaatatttccttttctacaatcttattcattcgtgttgctattgccgtttcatcatggcgaatatccgaaaaatcaataggtgctgaaatgttcaacgtatatccagagttatctttgttacgaagcggtgtaaaagggataactttgctcttaggtgatgattttattaagtagtaacttccggttgttgttgccgcctccggtacagcaaaaaaaggtacgaaaacagcattttttcttccataatcatgatccggagcgtaccaaatcatttcaccatgacgaatagctttaatcattgcacgtaaatctttgcgatccaataaacctttatttgatcttgcacgtccacggcattgtaaccaatccattaaaggattatcatgcggtcgataaatgccaatgcctggatgagatagaccaataatccttgcacctaattctaaagtgagaaaatgaatacctacaagaataataccgtcttgttgattttcttttaaatattcaagcccttcaattttgctccatttttttattcgtttatctgaccaaaaccaagccataccggtttcaataattgccatgcctgttgctttaagattggattgtaatatatcgttgatttcctgttcagaataatgaggaaaacagagctgtaaattttggcgagcgatttttgttctgcgttgaccgattttcaaacgagaaaataaagaacctaaaccgtttccaattctaagcaagattgggtaggggagtaataaaatcaggcggaaaaatagaaatcctaaccagaatagccaatatttgggtttaagaaattcaatattaaattgtggaattgatgtttttgccataatgttacttaatctaatacaactttgattttgcgtcgtagtttaacggaaatttgacgaaatagcatttttactgtggtaaaatcagcgaaattttagtgattttatgagagaaaagaaaaatgatgcaatattcagcacagtttaatcaagctaaagtaatggtgctcggtgatgtcatgcttgatcgttattggtttggggcaaccaatcgaatttcacctgaagctccggttcctgtggttagagtacaagaaaatgaggaaagagcaggcggtgcggctaatgttgctatgaatattgcctcgttaaatgtacctgttcggttattgggtttaacaggaaaagatgaagcagctagggcattaatgcagctattggaaaaacaaagtattcattgcgactttactcaacttgactcgcacccaactattactaaattacgtatcctatcacgtcatcaacaattattacgccttgattttgaagaggatttcaacaatataacaagtgcggatttattgtgtaagcttgaaagtgcggtacaaaaatatggtgcattaattttatctgattatggcaaagggacattaaatgatgtacaaaaaatgatccaaattgctcgtaaagtgaatatccctgtcctgatcgatccgaaaggaactgattttgcacgttatcgtagtgcgacgttgttgacgccaaatatgtcggaatttgaggcggttgtcggaaaatgtcatagtgaagaagagattgcagagaagggcttgcaactaataaaagatcttgatttatctgctttgctggttactcgctcagaaaaaggaatgacattattacgtccaaacaatgcaccatttcatttgcctacagaagcaaaagaagtgtttgatgttaccggtgcgggcgataccgtaattagcgtattagctaccgcacttgctgatgggcgtagttatgaggaggcttgttatttagcgaatgtggcggcagggattgttgttggcaaattaggtacatcaacagtttcaacagttgagttagaaaatgccattcatggcagaactacggcaggttttggcattatggaagaaagtcaattaaaagcggcggtggaattggcaaaagcacgaggagaaaaaatagtgatgacaaacggttgctttgatattttacatccggggcatgtgtcttatttagaaaatgcacgtaaattaggtgatcgtttaattgtcgctgttaatacggataattctgtaaaacgtcttaaaggtgaaactcgtccgattaatgatttagcgactagaatggctgttttggcgggattatcttctgtggattggcttgttgcgtttgatgaagatacacctcaacgtttaattgcagaaatattacctgatttattagtcaaaggtggagattacaagcctgaggaaatcgttggcagcaaagaagtctggctaaatggtggcgaggtcaaggtgttaaattttgaaaatggctgttctacaacgaatgtgattaaaaaaattcaacagttaaaagagtaagggaacattatgattacggtatatggtattaaaaattgcgatactgttaaaaaagcattgaaatggttagcagataacaatattgaataccaacttcacgattttcgtgtagacggtttacaacaatattggctagaacaagcggaacagcaatttggctgggaaaatttagtcaacaaacgtagtacgacatggcgtaatttagatgaagaaatcaaacaaaatctgactaaacagaccgcacttaaaaccttacttgcacaacctactttagttaaacgtccgattattttacaagacggcaaagcgttgattgggtttagtgtagaagaatatgaacgtgtattgaaataaaagattaacaacgttctatttaacgtatggcatattgcaatagtgcaaaatgaaactatgaattgataaaaggacagatgctacgcaaacgttcgtaaaaaaataaaatcttatgaaaaataacataattactctcactcaaagtcttattcaacgtccttcaattagccctgatgatcaaggctgtcaacaacttattgccgaacgtttacaagcggttggttttaagttggagtggttaccttttggtgataccttaaatttatgggctactcatggtgaaggaaaatgtattgcttttgcggggcatacagacgttgttccgattggtaatgaaagtcaatggacttatccgccttttgaagcccgaattgttgaaaatatgctgtatgggcgtggtgctgcggatatgaaaggtgctttggcagcaatggttattgcggcggaaacttttgtgaaacacctgccaaatcatcagggaaaaatagccttgttgattacctctgatgaagaggcagcggctaccaatggaacggtaaaagtagtggaaacgctaataaaacgtaacgaaaagattgactattgtgtagtaggtgaaccttccagtgcaacgcaatttggcgacattattaaaaacggacgacgtggttctattacaggaaatttgtatattcaaggtgtacaaggtcatgtggcttatcctcatttagcggataatcctgttcataatgccttgaaattcttagatgaattaactcattatcaatgggataaaggtaatgaatttttcccgccgaccagtttacaaatcgccaatattcatgcagggacaggtagtaataatgtaatccccggtgaactttatgtgcaatttaacttgcgttattgtactgaggtgacagatgaaattattaaaactaaagtgactgagatgttggaaaagcataagttaacgtaccgtatagactggaatttatcgggcaaaccgtttttaacacctcaaggaaaattagtaaatgccacactggaagcagtagaaaaatttactcaaatcagaccgcacttagatacaggaggaggtacttctgatgctcgttttattgccacaatgggagcggaagttgtagagtttggacctctcaatcaaactattcataaagtgaatgagtgtgtgaatattgatgatttagccaagtgcggtgagatttattattatattttggaaaaattgtttaatgaacaataagttatcaaaaatcctcacaggaaaaagtcgtgaacatttaatttcattaccgaatacgctttcggctaatcattttttgcagatggacgttgtcgctgcttttttgcagttacagcaagctgcaaagcaagctggctttaatttacagccagtaagtagttttcgtgattttgaacgtcagcgtttaatttggaatacaaaattttatggagaacgtaaagttcatgatgatcaaggaaatccgttagatttaaccgcacttgacgattggcaaaaagcacaagcgattttgcgttggtctgcgatgccgggagcaagtcgccatcattggggaacggaaatcgatatttttgatcctgatttattgccaaaaggacaatctttacaacttgagccttgggaatatcaaactggtggttattttcaacgcttaactaattggttattagttaatgcacaacaatttggtttttattttccattttttgagttaaaagataaaaaagtgggcaatgaactttggcatttaagctattttcccattgcagatatatatcaacaacaattttgccctgagttgttatcacaagcgtggtacgaggaaaacgttgcgggtagcgagatattattgaagcatcttgatgaaatatttagggattttttgatttaatgatttaagctatttttagccaatccaatttttaataattttagaggtatatatggaagttcagcaatttactcagcaagatattgaaattcttcatgaagaaacattgtacaaaggtttttttcaattaaaacgcattcaatttaagcataaactgtttgctggtggtgttagtggagttgtaactcgtgaattactttataagggggcagcatcagcagttattgcgtatgatccatatttagataaggtgattttagtcgaacaagttcgcattggtgcttacgatcccaaattaaccacatcaccttggttatttgaattaattgcaggtatggtggaagagggagaaaagcctgaagaggttgcactaagagaaagtcaagaagaagcaggcgttcaagtagataatttgcagcatgttttaagtgtgtgggatagtccgggcggagtgattgagcgtatccatttgtttgccggaaaagttgatagtacaaaagcaaaaggtattcatggcttggcggaagaaaatgaagatattcaggtgcatgttattagcagagaaattgcctatcaatgggtctgcgagggaaaaattgataatggtatagcggtcatgggattgcaatggttacaactcaattataaaactttgcaacaacaatggttataaaatgtgatacagattatattttttataaaaaattagataaaaatatgatcctgttaacattttcattatttttttaatgcaattttttattaaaacagtaagttataacccgtttgttgtatataaagggtgaatattttgatcagtacatatcaataccctacttcagagaaagtagttcgtttaattcagattaccgatccccatttatttaaagaaaaaaatggagaattacttggcattaatacgtatgatagttttaatcaagtattaagcgaggttttacaaagtaaatttgattatgagcttgttttagcaacgggagatttagtacaagatagcagtgaagaaggttatcaatattttgctgaatcggttaagttgttgaataaaaaagttttttggattccgggaaatcatgattttcaacctaaaatgtttgatgttttaagtcaatatcaagaatacatttatccgacaaaacatgtattagtgggaaaaaattggcaaattttgatgttggacagtcaagtatcaggcgtacctcatgggtatctaggacaatatcaattggattggttgtcagcaaaactgagagattatccaaaacgctatgccttagttgttctacatcatcatattgtttccactaattcggcttggttggatcaacataatttacgcaattccttagacttaatgcaagtgttgttaccttttagaaaagtgcggggcattttatatgggcatattcatcaagcaatggatacaaaatggcagggatataaaattatggcaacgccttctacatgtattcaatttaaacctgacagtaatcatttttctttagacacattacaaccggggtggcgtgaaattgagttatatgatgacggacgaattgaaacaagagttaaacggattcaacaggcaagttttctgccgaatatgttgagcgagggctattgatgaaaagcgaaaagtgcggtgaaatttttgattttttcaccgcactttgtcgttcaaatcataacaaataacattcgttaaaatttcatttctaatgataaagcaaaattacgtccggcagcagtaaagcgttctaacccttttccgttgttatatacgtcgcccaatgcaccattatatttaatttgtcgtaacgtatcccaagtggtgtacttgcgattaaataaattaaagatacctgcgtttaaggcgaaatgggagtttaggcgatattgtgcggttaaatcaaatacgacataagaactgcttaaaaaacgataaggtttgggttgtctaaagtcggatattttccctgtgtttttatcaacattcaattgcaagctatttacattcggaatatcaatagcatctttagcttttttagcactgacatatcgcccgctgaagagaacattccatttgtcgttatccgcttggtagcctaatcccaacgtcgcgctaaaaggctggattggtaacatcgccgtgccattatttttacgcccttttgcatagctggcttttaatatggcgtaccaagatttggataagccaactattttcccgttagcacgggcatggaaatcaagaccggtaacatcggctttatcaatatttatctgctgataatttacgccatctaaataatattcagtatatgtcgtttttggcgtggttttccagttagttctttgacgagagccaatttttggttttgtttcgacatcaataaaatcccgatattttgtataaaatacagccaagcttaattgatagttgtctccttctgtggtaagagagagttcatgattttgtgctttttcaggttttaaattgatattaggtaaatattggacatcacttgccccttttaaatcaaaatacatttcttctattttcggtgctttaaaacctgtgctgaattcatagctaagtaacgtggaatcggtgagcgaataatttaatcccaacgaaaaattgaccgcactaaattgtttcttgggtaaaacttcgactttttgactggcaagatcatattttaatgcacttgtggtgggcttatagcgatagtgatcgaagcgtattcctgcatttgctccccatttttgattaatactgattaaatcctgcacataggcataccaagcctgacgggcaacaggttgctgaatagtgaattcacgttgttttatccttgaataagcaccatactcttgatttctattttctaatttaccccaatgataacccaatccacctgataattgatgatgagcaaacttgccggcaatttcattggcaataaaagaaacatctaattgataatgcttctgttctgttttatataaacgcttgtcagtaataatattataatcttgcggagaaacaccatattgattggaattagcctgttgtgagactttttgttgggctaattgtacgctaaatttatttagccagctttccgttggggtataattataggaaagaccaaatcgctgataaggtgttatatcgcccgcttcttgacgatttgaagcataaaaacttttttctaaaatttttctgctttgctcaagattttcaaaaaaaccttgcacaaaatgttgtggagtaaaatgatatcctaattttgccaaccaagatcggctgtgataatccacattatcaggtaatacacgactacgcccacataattggggaaagatatctcgctggtctccatttggtaaaatgccacaatacgcaacgtcttttagtttgccactgtagtaatttttgttttcatgtgcatggcgataggtgtattgcaacaatccctcggcgttaccctgcttgaacccccccctatcacttggcgatattccgtattacgtgagctataggcagttttagcataaaatccaacagttttattcgagtctacaaaatcatgcacattttttgttcgcatcgacacgctaccgcccaacgcaccgctaccttgtgttaaagaattcgctcctttattaaattctacactacttaagttttcaatttccgtgctgttgcgattaccattataaaatcctttaatatagtaaaagcgaggcatataactttcgaccgcacttattccatcaacactcatcgccacacggtcgctttctacaccacgcatagtataaccattggcaccgccacgccctccttctgtgactgtaacacctgtttgccaacggaccaaatcctgttcgttccataccaaacctcgactaatttgttggctatttgtgcttgaagttttagccgatacttgttgcgtttcaacaacaatctgatctaatgtagcagaatcattaaattgagcgattgcattaaatgaaaataaaggcaacgtaacagcagaaaaccgcagtaacgtttgctgacgatttttattaaaaaacataatacccctcttgtaaataagaattaatctcattaataatagcagagatattgttatatctctatttattcttttatttatctaattggagaaataaaaacctttaaaatagcagaaatataaaattatccctttttcttactgacggtatctatccatactgccagtaataaaatgccaccttttacaatatattgccaaaaagtcggtacatccagcatactcattccgttatccaataaggcgatgataaatgccccgattactacgccaaaaatactgccgataccgccggctaaactggctccaccgataacacaagcagcaatggcatcgagttctgcattttgaccggcagatggagctccggctcccaaacgggaacttaaaattaagccggctattgccactaataagccgttaagagcaaaaatggttaatttaactttttccacggcaatacctgataggcgagctgcatcaatattgccaccaattgcgtaaatatgtcgaccaaatgctgtttttttcgaaatgaatgttcctataatggctaatccacagagaattaatactggaattggcatgcctcgataatcgttaagcagataaattgcaccaagaataaggattgctatcatgccatatttcactgtttctttgggcattttggcaactggtaaatttaggttttgtctggctttacgctgataacttccccaagcaataaagcaaaatattataatgctccctaaaattatccctatggtgtcggaaagataaccttgaccgatgattgtcatatcattgctgataggggaaacggtagtaccattcgttaatccgatcaaaattccccgaaatgcaagcattcctgctaaggtaacgatgaaagatggtactttttgataagcaacccaccaaccgctccacgccccgattagtaaacctaagagcaatgtaacaaggatagttaaaggtaacggccaaccccaccaaacattactaattgccgcaaagccaccgagtagccccattagtgaaccaactgataagtcaatttctgcagagataatcacaaacaccataccaatagcaagaataccggtgatagcagtttgacgtaataagttagagatatttcttgcacttaaataagccccttctgttgcaattgagaaaaaaaacataatcaccataatggcaatcagcataatatagacttgtaaattgattgatttgaacttattcatagcttactccttaagtgtggcttccattatttgttcttgagtgagatgatggttgattaaatccgctttaactttaccttggtgcattactaatacacgatcgcttattcctaaaacctcaggtagctctgaggaaattacaataattgacattccttcctgagctagttggttgattaatttatagatttcatattttgcaccgacatcaatacctcgagtcggttcatctaaaatcaaaatgttaggatgtaataatagacattttgctaaaattgctttttgctgattacctccacttagccggcctattgcgagttcaggcgaggaagttttcactttcagtttggcaatagattgattgataatggtttcttccagcggttcgttaatgacttttttaccaaagcagaattgagacaaagaagataaggtaatatttttacctacgctcataataggaataataccgtgttttttacgatcttccggtaccatgacaatatgattttcgatagcttccgcacacttgttgattttaactttttggttattgagaaaaatgttaccttggtattttcctacataagaaccaaaaatacattgagccatttcagttcgccctgaaccgactaatcctgcaacaccaagaatttctcctttccgtaatatgaaattggcattatcaacgcgtttaatatgtgtattggttgggtgccacgcagttaaattttctacgcgtaaaatttctttgccaatatcgtgtggctcgtgtggatacaatgaggtaatttcacgtcctaccatcatggtaataatgtcatcttcgcttatcccttgtgctaattgagtgccgatgtgttcaccgtctcgaattacacagatcttatcagaaattgcttttacttcatttaatttatgagaaatatagatacatgcgatattgtgagcttgtagacctttaatcagattaagtagaatgtctgtttctttttcggttaatgaggcggtcggttcatctaaaatcaataaacgaacttgtttattcaaggctttagcaatttcaactaattgttgttgtcctaatcccaatgcactcacttttgtatttggatcaatatcgagctgaacctgctctaataaggttttacaacgcagatacattttgttgtcattagtaataccggcttgggtaatttcattccctaaaaacatattttccaataccgacatatttttcactaaagtcagttcttggtgaataatcgaaattcctttttcttccgtatctttaatatttttagcggttaatttttcaccggaaaaataaatttctccctcataatcccctgagggataaataccacataatactttcattaaggttgatttgcctgagccattttcaccacatagagagagtatttcgccggtttcaagggaaattgaaatattatttaatgccacaacatcaccaaattttttagtgatattcttcatctctaataatttcgtcataacttcacccctttttttagtatggcaagacataaaatcttgccacataaaatattctattatttataaacagcctctttggtatggaaaccatctttaatcaccgtgtcatcaatattctcttttgtaacgacgacaggctctaataggaatgcagggacatttttcaatccgttatttaattgagagttggattccacttttccacctttacctaacgcgactgaaatttcggctgctttatctgctaaattagtgattggtttgtatacggtcattgtttgtgaaccgtcaagaatgcgtttgattgccgctaaatcggcatcttgacctgaaatcgctactttgcctgataagccttgagcacttaatgcttgaattgcaccaccggcagttgcatcgttagaagcaactaccgcatcaatattgtttttgtttgcagttaacgcattttccataatttgtaatgctttttcagctagccaagaatcaacccattgatcgcctaccacgttgatttcaccactgtcaatgtgcggttgtaatactttcatttgacctttacgaaataattttgcgttattatcaacaggtgaaccgcccattaagaaataattccctttcggttttttctcaataatgctttgtgcttgtagttcacctactttttcattatcgaacgaaacatagaaatcaatatctgcgttattgatcagacggtcataagctaaaactttaaccccctcttttttggcttcagcgatcacgtttgacaatacttcgccattgaatggaataatcactagcacatcaatatctttatttagcatattctcaatttgagaaatttgagctgtcgcatcaccatttgcagattgaacgaatacttttgcacctaaagcttctgcttttttcacaaaaatatctcggtctttttgccatctttctaaacgtaaatcatcaattgacatgccgattttcagatcgtttgctagcactgaatggctaaaaaccattaaagttgctgttgcgaccgctaataacttagatttaagtttcataaaatacctcacttggttgagagaatgatgtaagggtataatgtagttgccccgagtgaagtctgcggagatttggtaataagtgcaattatcagatttattaatgtaattatgttttttcgcttttgtgatctgttcgacattaaccaataatctaaatccaaaaacgaaatatcgtaattgagggttgttttcaattttaagatgatgagccttgtattcatgtttatcacatctcagaggagacttggctatgtctaattattttgacaaaattgcaaaggtaaattacgaaggagcaaattccactaatcctttcgcttttaaacactacaatccaaatgaagttattttaggtaaaacagtagaggaacacttgcgtctggcagtctgctattggcacacgttctgctggacaggtaacgatatgttcggtgccggttcattggatcgtagttggcaaaaaacaggtgatttgctggttggtgcaaaacaaaaagcagaaattgcttttgaatttttccaaaaattaggtgtgccttattatagttttcacgatgtagatattgctcctgaaagcaataatttcaaagaatatttacataacttcaatactattgtggatattttagagaaaaaacaatcagaaaccggtgtgaagttgttatggggaacagcaaactgctttactaatcctcgttatatgtcaggggcttctaccaaccctaatccggaagtatttgcttgggcagcagcacaagtttttactgcaatgaatgcaactcaacgcttagggggtgaaaactatgtattatggggcggacgagaagggtatgaaacattgctgaataccgatctcaaacgtgaacgtgaacaaattggccgttttatgcaattagtggtagaacataaatataaaatcggctttcaaggtacattactaattgaaccgaaaccacaagagccaactaaacatcagtacgattatgatgttgcaacagtttatggttttttaaaacaattcggattagaaaatgaaattaaagtgaatattgaagctaaccatgcaaccttggcagggcatacattccaacatgaaattgcaacggcaacttcattaggcattttcggttctattgatgctaaccgtggcgatccgcaattaggctgggataccgaccaattcccgaacagcgtggaagaaaatacgttggcaatgtatgaaatcctaaaagcgggtggtttcaccacaggcggtttcaactttgatgcgaaaattcgtcgccaaagtaccgacccgtatgatttatttcatgcccatatcggtgcaatggatgtgttagctttgtcgctcaaacgtgctgcaaaaatgattgaagaccaaacgttacaaaaagtggtcgataaccgctatgctggttgggatcaagagctgggtcagaaaattctaaatggcaaagcgagcttggaggatcttgctaaaatagtagaaactcaagggttagatccaaaacctgtttcagggcagcaagaatatttagaaaatttagtgaatagctatctttatcgttaattctgacaagcggtcattttttgcaaaattttgcataaaatgaccgctctttagattaaggagtatttatgtacattggaattgatcttggtacttctggggttaaagttgttttacttgatgaaaatcaaaaaattattgccattactcaaaaatctcttcctatttctcgccctcaacccttatggtctgaacaaaatccacaagattggtggaatgccactcacgaagcaatgcttgaattagctgataagcaaaatttaagccatgtaaaagctattggattaactgggcaaatgcacggtgctaccttactggataaggcagataacatactttctccggcaattttatggaacgatggacggagctttgctgaatgcgaagagttggaaaaattagtgtcaaatagtcgtgaaattacaggtaatgtaatgatgccaggctttactgcacctaaattatgttggcttaaaaaacatcagcccgatattgccaaaaaagttagtaaggttttgttaccaaaagattatttacgatttttaatgacgggagaatacgcttctgatatgtctgatgcctcaggcacaatgtggctggacataggtaaacggagttggaatgaagcacttttgaatgcttgtggacttgatttgaataatatgccgaaattatttgaaggtaatcaaatcacaggttatttacgcaaagaaattgcacaacaatggaaaataaatgccgtacctgttgtggcaggtggcggtgataatgcagccggtgccattggtataggactttaccaagcagagcaagcaatgttgtctcttggtacttcgggtgtgtactttgtggtaagtgatacattccgtgccaatccacaaaaagcagttcatagtttttgccacgcactgcccgatcgctggcacttaatgtcggtgatgttaagtgcagcctcggctgttgattgggctgcaaaatccctaggctttaaagatgtaccaaccttatttcaacgagttgaagcaagccaaaccgagtccaatgtcattttcctgccttatttattaggcgaacgtacaccgcataatgatccttatgcgaaaggtgtattttggggattaagccatagcgataatcaagttacgatggcaaaagccgtcatcgaaggcgtgagttttgctatggcagagagtattgatgttttacatgaaacaggtgttactgcaaataatattgctcttattggtggtggagcaaaaagtgcttattggcgacaattacttgctgatattagcggtaaaacatttaaatatcgtacaggtggagatgttggtccggcgttaggtgcggctaaattagcacaaattgcattaaatccagaacaagatattgcgaatttctgccgaccattaccattggaaaaaatctatcagcccaattctgctcgctatgcagaatatcaagctaaacgtgagaaattcgcagagctttatcaacgagtaaaaggtctatcattgttttctttgtaaatcaaagatatataaggcttttcttgatctaaaagtgcggtgagaataccgcacttttaggggtatattttggatacaaaaaaccggcgataacaacactgctatcgccggtttagttttatatgatgaattagttaaacacgccgctgaygccgacacggaaacctaytcgaccwcgrctrtcrgargamatrccgccggakayrgcmyatttwccrtttgcggaagttctaccgaggtttaaagagaccgcactttcgctgctataatgagcggcaccggcggcataagaccattttcccgggacgaaagggacttctttgaaagccatmgcggcggcgataccggctttagcgtctttgttgacytcttcaasacgttggttrgtkgcrtgwarytgrctaccrttkacygcatcrgtkgawtgatgagamaryaaacckgcagcaacattttgaatacgacgttcattgcctttgytkccyacggaaacgacrcctttcgcatcaacgccrgcgtaattgccgtcgactttgccgataccgcctgaagtctcgctcgggtcggtgtaagcggaactatcgcctagaaatacagaattatcttttgtatgttgaatgttgtagcctatagcaacagtatttttactattattcgtaatttgacgaccaactgagaatgaattttttcctgttgtatgtacaccactaccaaagcttattgaaccttcgccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcttcatcacctaacgccactgcaaaatttccagtcgctttagaatctttacctatagaaaccgcctgtacacctgcatttgcttggaagcccattgctacggcataagattgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaagagaaataacattttttcacttgaaagaaatccttaaaaaaagagttaatatagaaaaatcacaaaaaacataaccgcattatggtgcggttatttatgacaataattaaaaagaggtaggtagtcctaccggagcgggcgaaattttaagcggggggggggtactgtcaatatatttttttacaaaatgtttacttttttaacaaaattgaaacggtaaaaaacatttgtcgaacacggaaaaatattcatttgtttttgtgttatggaatgcagtagaaagaagaaatgaacttgcgtaagtgatttaaacgctccacgcattttcatctagtacttgtccaaaatgactttcaacgaggcgtttggttatatcgctttgtggttgggtaaagattgtttttgtatcgccatattcgatcatttgtccttcgtccatcactaatacatgatcggctatgtgtttgatgatgcctaaatgttgacctacataaatataagagatgctgagtttctcttgaatgtctaacatcaaatttattaattgagttttgactgtcgcatcaagtgagccgagagcatcatcggtaataataatttccggtccaagaataagtgcacgtgcaatagcaacacgttgtttttgaccgatggacatagtattaatttttacattggcatgttcgggataaagtcccactaaacgtaatgtttcagctattttaagattacgttcattttcgtttaggttggttgtcaggcgtagaggtgcatctaaaatttgtcctacatttaaacgaggattaaaggcagaataggggtcttgaaagaccatgcgaatatgttgtgaacgatattgataatctccgtactctaagggatttcctttaaatagaagttcgccagatgtgggttttataataccaacgatcattttggcaacagttgattttccggagccatttttaccgataatagccaatgttttttttcgtgccaaaacgaaactaatattttctacagctttaaattggcttgtgctgaagataccaatattatcattaaaaaattttgataaacctgaaacttccagtaagttcatttttacttcctgttcttattttgttgtgtttacgactaatgggccagtttccatttctttttctctacgttgactttcttttaaattaatagggaaatggcagaaaaattcatgttgtttaatccgttgtgcacttggttttcgaatacattctttttgtgcaaaaggacaacgtggacctaaacggcaaccgataggcattccttctaataatggaacagcaccttttagcgtactcaaacgacttttatgtactaagggctgtttaaaatcaggaatagaatgtaataatgctcttgtatagggatggtgaggattttctaaaatgttttctttagatcctgattcagcgttttgtccgcaataaagaactgaaaaactatcacaccatgcactaatactatttatatcattacttaccagcagaatacttgttccctgattttgattcatactggcaagtaaacgaaatatttgtacttttgtcattgactcaagagaatttgtaggttcatcagcgattaataatcgaggttggtttgcaattgcaagggcaatcataattttttgtccttcaccttcagttacttcatgtgggtaactttgcataatatctttatgatctttcacacctacacgatgtaataattcaatagcacgacgttttttccaaccgaaccattgccaccatcgccctttaaatgtccaagagggaatgctctgaataagttgttgtccaatttttcggctgggatctaaagatgctaaaggctcttggtaaatcatggagatttctttacctaccagtttacgtctttttttgggatttagttttagtagttctacatcgtcaaaacgaaaacgatcggctgtaataatccaagaatccttaattgcattacaaataactttagcaatcaggctttttccggaacccgattcaccgactaaaccacagatttcaccttcatttaaggttaaattaacattatcaataattttgactcgtccttttggtgtttctatttcaatacaaagattacgaatatcaagtaaagccatgtcggttgtccttatccataatatttttctatggctttacaaagcccattagtcaaaatgagaacgataacaatggtgatgataatagcaacaccgggtaagattgttgcccaaggggcaagataaattaattctatataatcttttatcattgttccccattctggcgttggtcgttgtgcacccaacgaaataaaacttaatgcactaatatcaataatggcaatgataaatgctctgctggtttcatgaatataacgaataataatattaggtaaaatggtttcttttacaagttgccaattacttgcaccatcaagtcgtagcatcaaaatgtattcttttttcagttcttgttgtacggcttggtaaatttcatgaataaaatagggaagtaatgcaagcgtgatggcaagcattgcattgattaagcttggttgcattaatgtagcgataataatagcgatgagtaaaatagggattgataagaaaatatcaaaaaaatgtcctaagactcttgcttttaacccttgtgataatcctgcccaaataccaagaattccacccaaaatagatgtgaataatacaacaatgagggcggcaccaaaagtgtaagttgtacctcgaatcaaacgactaaaaatatctcgtccaatatcatcagttccgaaaaaataggcaatttttccgttatcagcccaagagggaggtagtaactcaaaaccaataaactgtgctgtatcactataaggtgcgataaattgactgaaaagtgcggtaataatgagtaataaaaaaagataaaagccagttaatgccaatttatcttggtagaaaaatttccaaatatgttttaatccttgtgtttcgcgaaattcttcaggttctttatctagcataccagttcttcttattaaatgggtccaaaataaaggataagaattcagtaaataaattcactgcaataatacaaaatccaacaacaataatgcctattgaaatgctattataatcttgttgtctaactgcatctattaaccaatgacctataccgaaccaaccgaacgtgctttcaatcagcatacattgagccataacaagagtaaataaacgactcatttgcgggatcatgataggtattgtgttacgtaaaatgtagatttgtagaatttttctttttgaccaccctcttgtttctgcaattttgacataactttgggtgaataaaaaatcagctcgttgctgaacgattctaataatatccatagttggtagaattgcgagaactaatgtgggcaacacaagatgttgcaaaacattttgaatcattttaatacgataaggctgatccgtaaaccaaacatcaataataggaaagcctgtaatgggctttatctcatacaataaattatactgtccaattgctgaaatttcccaattttgaatagctgaaaagtacaacaagattggtgctaaccaaaaaacggggatagcaatacctgtgatatagaaagaacgaatagctttgccacacaaattatctgcatataatgcactgagtaatccaagaggaataccgaaaattaatgctaacagcattgcactaacacatagctctaatgtaggaggaagtacagcaaaaatcaattcttttagtgattctccgccgtggtaagtaataccaaaatccccttgtagtaaattttgtagatagaaaaaataccctgaaaaaaagtgcggtgttgctagcacttgatttaatggatctttgagcaggatgctgtaactgatgagagataaaataaacagcgtgctgataactaaaatgcagtgacgaaaaaaggaaaatagcattgttttattacctgtttataatttctattattttttaaatgacagttttgaaaaattaatattgccaaacggcgttaattcaattccctgtacttttgcatttgctaacagaacacgttttacgttagcaataggaagaatagggatttcggataaaataatttcttgtgcgatattataatattttgcacgttcacgtaagttcgatgcggctaatgcttgatctaaggcgtgttcaaaaggtgcatggcaccaatttgaaaaattagttatttcgttttgtgtaccgcaacttaaaatgggacgcataaaactatcagggtctagatttcctgctaaccagccagttaagataatatcgtaatcctcagtttgttcttgaagctgtttcattaaataagtgcgggtaacgttacgtatatttacattcaccccaaccttaattaaatctgctttaattaattcagccatttttattggcgaagggttatacacttgttcttcattaataacccacatatctagatttatattttttcctgcaaagtattcctttgcttttttgacattatagtcataggcaaaatcagttgtatttacaactgccccccaagatattgatggaataatattgttcgcaacacttgctgtattatgataaatcaggttaataatacgttggcggttaattgcatgagcaatatggcgacgaatctccagatcttgcataagtgttttttgaaagttaaatgcgatataagataaattcatgccttcaattgattttatataatatttttcatcattgtgacgcaataaccctaattggctcagttctggataagaggcgatatggcattcattattgaagaatttaattaatctgcctgagcgattagtggaaagatcaatgatcacgttttccaggtttacatttttttgccaataattagggttatgaacaagacgaacatattgattacgaaagtaatctttaacctgataaggacctgtgccgacaggtaaattatctaattgcactaaattgtcgtccgcattgagttgcaatgcgtattcttgagaaaaaataatggcgtattggctggctaggtgggaaagcacggaagcatcgggtttaaacaagataatttgaacttggtaaggattgattgctttcacttcctgaattttttcatttaatttaatgctgtcaaaataaggaaaatgcacttttttacgttgttcgtgatagaccttatattgtggatttttatagtgaagagtgttttgatctaattccggtagtgctatattttgaccgagtatgcgatttaatgaaaaaaccacatcttccgcattaaaatcacggcttggtgtaaaccagtctgtatgatgaaatttaacgcctttgcgtaaattaattgtaataattttcccatcaggtgagatactataggattttgccaaaactggttcaagagttgcactatgatttttaatttcaaataatttattgtaaatttgctccgtgactatattcatactggttccggcatctgcagtttgaggattaaaggaaaaactgcttgcattggtacaataaatcaaaccgttgctagtgagtattttgggtatttttggggcactaaaagagggcaaactaaagagtagcccatagaagagtgtacataatataaaaatcttttttgccaacataacttaattaattatgataaattatatgggaattgtaaggcatattaacgcaatatagaaataaaaatgtttaattttatccataaagaacttgatgaactcattaatcgtggaatggaccgcactttacgtattgccgttacagggctgagtcgtagcggtaaaactgcttttattacaagttttattaatcagctattacatattaattccattgacaataaacatcttccgctatttttacctgcacaaaataaccgtcttcttggtgtaaaacgtgttgaacaacgagatctcagtgttcctcgttttgactatgaacaaaatatgaaagcgttgaagcgtgagcctgcaagttggtttaaatcaacggagagtgtcagtgaaacacgtttagccattcgttatatacgtaaagatggcttaatgcgacatttaaaagaaaaaggcacattatatgtagaaatttttgattatccgggtgaatggttactggatctgcccttactggatttggattttcaacaatggtctttacagcaacaagagctatttattgagcaacgacaagaattagcacaaaactggctgaataagatccgcactttagatttaagtgagccggcaaatgaagagatattggcacaacttgcccaagactatactgaattcttatttgcttgtaaaaaacagggatttcatttaacacaaccaggacgctttgtgctacccggtgaattaaaaggtgctccggtattacaattttttcctctggttcatttaactgagcaagagtggaaaagactaaaagagcggtctaaatctgacagttattttgcgatgttgagcaagcgttatcatcattatcaacaaaaaatagtgaaaggtttttatcaagaatatttttctacttttgatcgtcaggtgattttagcggattgcttaacaccacttaattatggtcgccaagcgtttcaggatatgcaaaatgctttacagcaactattcaaaaatttccattatggcaagcgaactttattcaatcgtttgttttcgccaaaaattgataaattaatgtttattgcgaccaaagcggatcacattacattggagcaatttccgaatttagtgagtttaatgcgtcaattagtacaagagggagggcgttacgtagaatatgaaggaatagatactgaatatactgcaatttccgccattcgttctactcaacaagtacaagtaacgcaaaatggacaaaagatcaaagcattacaaggaattagatcaatagataagaaaaaaattgttgtatatcccggaagtgtaccgagtaaattgcctcatgcagacttttggcagaagtatcattttgcgtttgatcaattcgaacctcttacagtggaaaatggtgagccaatcgcccatttacgtatggatgctgtcttacaatttttattagcagacaagttagattaggatataaatatgccaaaaaaggtttttcaacaagaagatgttgagcaaaaaatcacagaaaattttgagcctaaacaagaatttgagcaagacgaattagatatagaaatggactgctctcaatttgaaacaacaatggatcggcaaaatacagatattccttttcagcatatggttagaccaaaagtgacaatgtggcaaaaattgctcatggctacgatctgtttgtttagctgtggcattttggctcaatcggtgcaatggttggttgatagttggcgggataatcaatggattgcttttgtttttgctatggtcagtttatttttggttttgttagggcttggaacaataataaaagaatggcgacgtttagttcaactaaaaaagcgtttgatattacaagaaaaaagccgagaaattcgctcaaaaagtgcggttaatttaactgaggtttcttctgagggcaaagagttgtgtttaaaaattgcctcgcttatgggaattgatgataaatcgccacaactcattgcttggcaagaacaagttcatgaagcttacactgaacaagaaattctgcgtttatttagtcaaaatgtactaataccttttgatcgggtagcgaagaaacttattagcaaaaatgccgttgaaagtgcattgattgtggcagttagccctttagccattgtggacatgttctttatcgcttggcgtaatattcgtttgattaatcaattagcaaaactttatggtattgagttgggctatgttagtcgtctccgtttgttacgtatggtttttgttaatatggcatttgccggtgcggcagacgtcattcaagatctcggtttagaatggttatctcaagatataacagcaaaattatccgcacgagttgctcaagggattggcgtgggcatacttactgcacgcttaggtattaaagcgatggaattttgtcgccctatagccgttgctccagaggagaaattgcgtttaagttatatccaaacagaattattgggaacattaaagacgactttatttagtgccaataaagtgaaagagaaagtgcggtagaaataatttattagcttcaaaaagcaaagattatatacataaaatctgcactttaataagtctgttaaactgttagagtgcagattaaaatgaccaatttttactcttaagcgacaacattaaattgtgctttcatcaatgcttcgaaatctgtgcaaccgccaataggtttttcatcaatgaaaatttgcggcacagtttctaccggtttaccgacagacaatgatagatccgctttactaataccttcagcaacaatatcaatataacgataatcgaagtcttcaagggtattttttaatttttccgctaagttttttgcacgaacacaatacgggcaacctgaacgaccaaaaataacaacgtacatatttattttcctttttgttttgttaataaaaaagtagcgatattctaactcatttggtacaagatttttagcattgttacaacgaaaaaagcctatttctatcaatatcagaaattattcctaactatcaataagttcaatagtcacaccgttatgtaatcctctcggtagaggcgatcctttgcgacctcgctccgcacgaaatttttgtatatcctccggttttaaggtgacttttcgttttccagcatgaaagacaagactggttttttcgctgatcaagaataatttgaccaataattctgaccgctctttagcatttgcagcgggaatatgaatgattttgttgcctttacctttggataattcaggtaagtcggcaacaggaaaaaccagcattctattcatggaagttaaagcgaccaaaagtgcggtagaattttgcaaaactaatggaggtagtacgttggcattttccggtagggaaataaccgcttttcctgccttattgcgagataccaaatcttcaaatttacaaataaatccatatcctgcatcagatgccataagcaaagattgattttcgttttctatcagtaaatgttcaatagtagcaccgctaggtaaggtcaattttcctgtaagcggttctccctgtgatcgggcagaaggtaaggaaagcggatctaaagtgtagctacgtcctgtgctatcaataaagaccaccggctgattgcttttaccgcaggcatgggtcaaatagttatcaccggtcttgtagctcaaagcccgtgcattaatatcatgtccctttgcacaacgtacccaacccatttccgataagataattgtaatcggttcgctcggtgtcatatctgtttcagaaattgcttttgcctcagcacgttctactaaaggcgataggcgagggcttgcgaaagttttcgcatcttgctgaatttcttttttaattaaattatttaagcgaatttcagagtttaatatttgctctaaactgttccgttcttttgctaaattatttttttcagcttgcaattcttgttcttctaatttggctaaatggcgtaagcgtaaatttaaaatcgcttctgcttgttcatctgttaaattaaagcgtgcgattaatatttctttgggtttatcctcattacggataatttcaataatctcatcaatatttaaaaaagcgatgagtaggccgtctaaaatatgtaaacgagctaacactttatctaaacggtattgtaagcgacgagtcaccgtttgacgacggaaggttagccattccgttagaatttgaacaagattttttaccgcgggtttattgtccaagccaatcatgttcatgttaacacgataacttttttctaaatcagttgtggcaaataaatgagccataagtgcatctgtatctactcgatttgatcgaggaacgatgaccaatctaattggattttcatgatccgcttcatcacgaatatcttctaccattggcagttttttattctgcatctgctcggcaatttgtgccacaatttttgacggagaagattgatgaggaagtgcggtaataattatttcgccattttcttttttccataccgcacgcattttaattgagccacgtccctgttcgtaaattttacgaatttcttctttcggtgaaataatttccgcttcagttggaaaatcaggaccttgtagtgcggtcatcaattgatctaaatctgcattaggattatctaatagcataattgtggcatcggcaacttcattaagattgtgcggtggaatatccgttgccatacctacagcgattcctgttgtgccgttgagtaaaatatgaggtaagcgtgcaggtaaatattgcggttcttctaatgtgccatcaaagttggcttgataattgactgtgccttgtcctaattcagataataaaatttccgaaatttttgataagcgagattcagtataacgcatggcggcaaaggacttaggatcatcaggtgccccccagttgccttgaccgtccacgagaggataacgataagagaaaggttgtgccatcagtaccattgcttcataacaagcactatcgccatgcgggtggaatttccccaacacatcaccaacagtacgtgcagattttttatattttgcactcgcattgagtcccaactcagacattgcataaataatacggcgttgaacaggttttagcccatcgccaataaaaggtaaggctcgatccatgatgacatacatggagtaatttaaataggctttttccgtaaactggcggagtggcatttgttcaatgccttcgtagttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaatctacttgatcaccgttattttgtaaccaaattttccgatcttcggaacgttttttagctaataacatatccatcaattctaacgtggatagatcttcttcgtggggttcgtaggttaattgcaccaaacggcgagtgtttggatccattgtagtttcacgtagctgattaggattcatttcacctagccctttgaaacgctgaacattgagtttgcctctcttattttttaagcgtgccaaaatgctctctttttcgttttcatcaagagcataaaaaacttcattacctaaatctatacgataaagtggcggcattgcgacataaacatggccattttgcactaattttggaaaatgacgtaaaaataaagcacaaagtaatgtggcgatatgtaatccgtcagagtcggcatcggctaatatacaaactttaccatagcgtaattgagataaatcttcgttgtcaggatcaattcctaatgcaatagcaatatcatgaacttcttgtgaacgtaaaacttgatccggtgaaacttcccatgtgtttaaaatttttccccgtaatgggagaattgcttgatgttcacggttgcgagcttgtttggctgagccaccggcagaatctccttctactaaaaaaagctccgttttacttaaatcttgttcactacaatccgctaattttccgggtaaagcaggaccactgactaattttttacgcacaactttttttgctgcacgtaaacgtctttccgctgaacttatcaccatttttgcaagttcttcggcatcttgaatattttgatttagccataaactgaaactatcttttacaacgccgccaacaaagaccgcactttgacgagaggaaagtcgttctttggtttgacctgcaaattgtgcatcgtgcatttttactgataacacataagcacagcgatcccaaatatcgtcagcggttaatttgacatttttgggtaataggttacgaaactcacaaaattcacgcatagcatcaagcaaaccttgacgtaagccattgacatgagtacctccctgaatggttggaataaggttgacatagctttcgttaagtaattcgcctccctcaggtaaccataataatgcccaacttgccgcttctttattcgtcgtaaaatcaccgacaaaaggggtttgtggcaagaggttataaccattaacattttccattaaataatcagataaaccgtcttggtataaccaagtatcctcagtgttattgattttatcgataaatttaatttctaatcctgaacataaaactgctttagcacgcaataaatgacgtaagcgactgactgaaaaattagcactatcaaaatatttcggattaggtttgaagtgaacggaggtcccggttgtacgctttccgcaagtgccgataatctctaattcttctaccttaacgccgttttcgaaggcaattttatagatttcaccgttacgttttacctgaatatctacacgctcagataaggcatttactacagaaatacccacaccatgcaaaccacctgcaaattcatagtgcttattggaaaattttccgccagcgtgaagtttagttaaaataacttcaacaccggatactttttctgtcgggtgaatatcgacaggcattccacgcccattatcaatcacctctagagattggtctttatacaaaataacttcaattttggttgcgtgccctgcaagtgcttcatcaacactattatcaataacttcttgccctaaatgattagggcgagacgtatccgtgtacataccggggcgaagttgaacgggttcaagatcttttaaaacggttatttcttgtgctgaataatttgtcataatgccatgtgatcagtaaaaatttggagaattttaacaaaaaaagtgtcacctttcatcttgattgttgtgtatcttcttttgaattccaaggagcaacccagaataggcaaagcataccgggaatggctaaccagaaacaaaaccaaaaatagtcatagtatcccaagtagttgattaaaacgcctgcttgtgtattgaaggtaactcgaggtaaggcggcaaagctggtaaataaagccaattgagtggcggtataaatcggattggtttcacgtgccataaaggcgacaaaggcagaagtacctaagccgatgccgatatattcagcggcaactactaaactgagggaaatcagagcaaaattatctatttcttcaaatgggcctaattttgccaaccatgcaaagcctaaaattgttacaatttgtacaacaccaaaaagccataatgcacgattaattccgattttcagcatgatgacaccaccaataatactggcgatgagcatcggccacaaggaagaatttttgaccactatgccaatttgggtcatgttataacccatatcgagataaaacggcgaaatgagggctgttgccatactatcgccaattttatagagaaaaataaaagcgagaataccaagtgcggaagacgtgcctttgcgtgtaaaaaattctttgaacggttcgatcacattttcttttaaagtgcggtcattttttagctgaatttgaggttctttacttaaaaataaggtcataaaaataccgggaagcatgaagagtgcggtaattaaaaagaccgttttccaaggtaaatagtctgccagaattaaagaaagtgagccgggaacaagccctgcaatacgataggcatttacatgaatagaattacccaagcccaattcacgatcagagagaatttctcggcgataagcatcaagtacaatatcctgacttgccgaaaagaaagacaccagcactgcaatacctgcaatcagttgtaaattaaaggaggagcttggttgtaaaaaaccgaagaaagcgagtgaaatgagcagtaaaacttgcgaaatgagtaaccaacctcgacgccgtcctaaaaagggcggtataaaacgatcaagtaaaggagaccatagaaatttccaagtaaaaggaagcgttgtagctgtaaaataacctaaggtttccaaatctacgtgttctttacgtagccaaagtggcaataaggaaatgataatataaaaaggtaatcctgagctaaagcctgtaaacacacaaataagcatattacgactaaagatttgttgtagcattgagtgagatttttccataatttttccgtatgtataaattttttcaacagtatagatgattttttcacgttcatgataggatttttttattcacataacaagtagataaaatcttttacgcaaacgtttactatttgaaagtttcaggtaaaatacgcgaactttttttattcattttaatttgcctataggggacgctatgtctttagaaaaaacttttgagttgacgaaacgtggttctaacgtacgtcaagaaattattgccggattaacaaccttcttggctatggtttattcagtaattgttgtaccgaatatgctgagtgcagcgggatttccggcagaaagtgtgtttatagcaacttgtttggtagcaggattaggttcaattttaattggcttatgggcaaatgcaccgatggcgattggttgtgctatttcattaaccgcctttactgcatttagcttagtgttgggacaaggtgtgagtattcctgtcgcattaggtgcggtatttcttatggggatagtctttactttaatttctgcaacaggtattcgctcttggattttacgtaatcttccgtcgagtattgcacatggtgcaggtattggtatcggtttatttttgctacttatcgctacaacgaatgtgggtattattgtagccaatcaaaatggcttattagttaagtttggtgattttacgtctttctctgtgctgatgtctttggttggacttgctgtaattattggcttggaaaaaatgcaagtcaaaggtgggatcttatgggttatgatcgcaattacgatcgcagggcttatttgggatcaaaatgtacagtttaaaggcgaaattttcagattaccgacttttggtgaacaatccttatttttagaattggatattatgggagcattacaaccggcaattttacctgttgtttttgccttagtaatgaccgcagtatttgatgcaacagggacaattcgtgcagttgcaggtcaagcaaatttattagataaagatggtcaaattatcaatggcggcaaagcattaacagcggattccgtaagtagcttattatctgggacacttggtaccgcacctgccgctgtatatattgaatctgccgccggaactgctgctgggggtaaaacaggtatgacagcgattgttgtcggtatactgtttttattaatgctatttttccagccattagcaagtttggtgccaaactatgcaactgcacctgcgttaatgtacgtaggattattaatgttaagcaatgtcagcaaacttgattttagcgattttgttggagcaatgagcggactggtttgtggcgtatttattgtactaactgcaaatattgtaaccggaattatgctaggttttgcaactttagttatcggtcgtttagtttgtggtgattggaaaaaacttaatgtaggtacagtcatcattgccattgttttggttgctttttatattggcggttgggcaatttaattgtatataaaatgttaggtgggtaagcttagtcagctctcgaaagtatctacaaaaaaccggcgataacaacactgctatcgccggtttagttttatatgatgaattagttaaatacgccgctgatgccgacacggaaaccaactcggcctctactatcagaagaaatgccgccggatatggcatattttccgtttgcggaagttctaccgaggtttaaagagaccgcactttcgctgctataacgagcggcaccggcggcrtaagaccatttwcccgggacgaaaggsacwtctttraaagccatmgcggcggcgataccggctttwgcgtctttrttgacctcttcaacacgttggttrgttgcgtgtaattgrctaccgtttacygcrtcrgttgagcgatgagaaagcaaaccggcrgcaacattttgaatacgrcgttcattgcctttgytkcccacggaaacgacrcctttygcatcaacgccggcgtaattgccgtygactttaccgataccgcccgttgtytcgcctttttctacataagcagaagaatcaccgaggaagacggagttattagcggtattatgaatattattacctayaacaacggygtttttagaacttgcttgtatgatgttattatgccccatggaaacagctcccatagcataattgttagtttgagatcctatcgatacaccattctcagcagttgtatttgtaccactaccaaagctcaatgcacgcttaccggatgcttttgcttcaggaccaatagcttgagcacgttcaccacttgcttgtgcactccaaccaagtgcggtagaaatttgacctgtggctttagcagctgccccaaatgcattagcccaactattagcataactatttctaccgatagcaaaagatgattttcctttcgcattcgcttcatcacctaacgccactgcaaaatttccaggygctttagaatctttacctatagaaaccgcctgtacacctgcatttgcttggaagcccattgctacggcataagattgagttttagttccacgaccaaccgcagtagccccttcttttcctgcatctgcctcataacctacagcaacagcggactcgccgacttttgagccttttccaatggcaacggctttgctttcacccttaagagaatttttttgaggatagccagtattttcaccaatataaaccccacckttttcaatcttaatatgattattaccattacttgattgttgagcttgagccatarccgaatkagcagytaaaacaasyacygcasytaaagakaaataamawwttttcacttraaakaaatccttaaaaaaakagttaacatagaaaaatcataaaaaancaaccgcactaagaggcgataatttatgacacgccttaaaaagaggtaggtagacctaccaaagcgggcgaaattttaagcggggggggggtactgtcaatatatttttttacaaaatatttacgtatttaacaaaattgaaacggaaaaacatttgtcgaacacgaaaaaatattcatttgtttttgtgttatggaatgcagtagaaagaagaaagaaaaaatgaaatgataattggcggaacggacgggactcgaacccgcgaccccctgcgtgacaggcaggtattctaaccagctgaactaccgctccgcaataaaagaaataataagggaaagcttggcggaatggacgggactcgaacccgcgaccccctgcgtgacaggcaggtattctaaccagctgaactaccactccgcaaaagtggagtgcataataatagtgaatagatttttcgtcaagttatttttatttattatgcacttatttttgctaagtgttgattaagcaaacattaatgcatcgtttcttttgtatttcgcttaaaccataagcaattttttttgcttttttggtttagcaattttagataatcttggtgagccagtttttcttcttctgtgggtaaaagtaatttgaaattatgagtattggtagtatgttgatgaatattttcttccatcgttataatcggcgtatgttcttcatcaccaaataaactggtttgcccccctgtcatggctaaataaacatcacctaaaatttcagcatcaagtaatgccccgtgcaatgttcgtttactgttatcaatatttaatctgtcacaaagtgcatctaaactattacgctttcctggatacatttgacgagccatttgtaacgtatctgtgattaagcaaatatccgctgtattgatattgaaattgtgttttttaaactcataatccataaaaccgatatcgaaaggtgcattgtgaataatgagttcagcccctttgataaaatcaataaattcctgtgcaatagctgaaaaatccggtttatctgccagcatttcatcagtaataccatgtactttaattgcttcaggatcaacgaggcgatccggttttatgtaaagatggagttttcttcctgtgtagcgacgattgatcatttcaaccgcaccgatttcaataatacaatgcccctcataatgtgcaccgaattcgttcattccggtcgtttccgtatctaggataatttggcgattttgtgtgatttctaatgtcatactattttgctgttgcttgaaatgaatttgcggtattatcaccccatttgagaaaaattagtagagaattatgttaaaaaaaattgaaatttttaccgatggatcttgtttgggaaatccaggggccggtggaattgggattttgttgcgttataagcaacatgaaaaaaaactgtatcaaggcttttttcaaactacgaataatcgtatggagttaagagcggtgattgttgctctaaatagtctaaaagaaccctgttcagtgattttgtatagtgatagtcagtatatgaaaaatgggattacaaagtggattttcaattggaaaaaaaataattggaaaaccagttcaggtaatgcggtgaaaaatcaagatttgtggtgttcattggatcaagctattcaaaaacatcaaatagaatggcgttgggtcaaaggacataatggacatcgagaaaatgaaatttgtgatcagcttgccaaacaaggtgcggaaaacccaacgctggaagatgttgggtatcaaacagaatagaacaggctaaataaaattggagaaaaagagtaggcgaaataaatgatttgactccaaaatattcgcctttatttttaaggtaattttgcaatgactgcataaccctcttttagaccttcaatttgataattagcctcggcacaaataaaagcactctctccctgttttaattcaagtgcggtgtgatttgcggttatttttaatgcaccttgcatgacgagtaaaatctctgcgttacttgaggttagggggtgtttttgttgcatgctataacgtacgtttgtcatggcaaaatctttagcgggcgtagtgtaagtaaagatatcttgatcttgtggtgcggtaagaataatgttaggcgtaacctcactacaatcgacaatttttagcagttcctcaatatttatgtgtttcggtgttaatccgccacgaatgacattgtccgaacatgccattaactcaatattctgacctcgtaaataagcatgtgggatacctgcatcttgataaattccctcgcctgtattgagatgaacaatattaaataaatagaagcaaattaaccccgcatccagtttgtcagtcggtattttcattgcttcgattgtgtataaaacccaatagtcgggattatttaattccagttttccctgtctataagcaacctgattttcagtcataataggggatagccacgcagaaagttgagtttgatcagcttgcataattgttgcataaaaactgtgtaagtcttgattttccagctgttgggcaagtgcggtcaaagatggacgagctttgaaggtttcaagaatttttgttttttgtttaaagccatgcaaaagccagaaatcagataaggcaatcatcatttcaggtttatggtttcgatctttataagttcttttcggatcttttaaatctatggctgcaagattctcttgtgcaaaacctatttccgcttgtttttttgttgggtgaagttgaattgaaagcggttttgcaacatctaaaattttcagcaaataaggtaattcctgtccaaaattcgttagggttgctttccctaaaacttgtgggttttgtagtaagaaatctgttaacagcactgatttttccgacatatttaatagagaaggggcggaggaatgagcaccaagccaccattctgcataatattggttgtgttgtttttctatgtttaacaactcgggaaggtaattttgtccaccccaaacatagtgttgtagacgaccttgtagctgataaatggtattcattttgctgtccttttatttgataatgacttataaccgccgaaaaaatgaactattttttctatatcttgtaggttttctggtgaaatcatgagatgttttttattttttaactcaataatcagagtgttattttcaagcagattaatttgccgaattttagcataatcaatataaatattttcaaagaagaagccttgttctttcagtaataaaacaggaaagcgaataaaggcaatataaagactgagaagaatggtcattgctaataaatagagggttgttgtattaatttgtcctgaactttgatagagaatgatggtaacgagtacaataaaaataagtgcatctatttttgctcgctttttcaaccgcactttcaatttcgttgttcctttaagatagtccatcagaaattgatcgtaaaaggcataaagaaagaagcaacaaatacccacaataagaaaggcattaaccatatattacattcctaaaatgaaaaacttctcccgtgcagggagaagttttcggataaattaagctaagatacctgttgcggcacctaaaataccgataataaagataccggtaataatccataatgcgttaatacggttgcgtaataaccacatacaggcaaaagtgaacaataacggtaataatcccggcatcaaactatcaagaatattttgtacagtcgttgtttcaattgtgccgtcttgtttttcaataacggatacgactaacggtacattaatactggtccatttctgcactaaagcccccataatgaacaaaccaagaattgatgcaccttccgtaagtttttgcaacaatccgccactcatatcctgaacaacgtccaagccttttttatagccataagtaacaccatagtaacgtgttgctaaacgaactaaattgaatagcacgaagaataaaataggacctaaaatacttccattgatcgctaaacctgcacccaaagcagcaaatacaggtcttgcagtaccccaataaattggatcaccgacccctgccaaaggtcccattaagcctactttgataccgttgattgctgcatcatcaatttctttaccgttcgcacgttcttcttccatcgcaatagtaacgcccaataccggtgcagcaacgaaaggttgcgtattaaagaattctaaatgacgtttaattgcatctttacgttcttgcgaatttggatccggatataaacgtttgatcacaggaaccatagaataggcaaagcctaatgactgcatacgttcgaagttccatgaaccttggaaaatgtttgaacgaagaacaacggcatttaaatcactttgggttacttttttcatttctgttgtcattttttggattcccattaatctaatctgttatctaaatcattattgttatttgctacaacttgtaccactttactttgattgtatttcgggtgaagctgaatataaagtgcggccatgattgcaccaagtacaccaagagcaacaaggttgaaatcggtaaatgctgcaataacaaaaccggcatagaagaatggcattaaatgacctgcacgcatcatattgatcaccatggcataaccgacaaccgcaataataccaccggcaatttttagaccgtttgttacgactgctggaatagcatttaacatatcttgtacaacatcggttccggctgtcaacgcaacgacaagtgcagggattgcaatacgcattgcttgtaataatagtgcactacgatgaatccaatctaagcgggttaagttaccgtcttcaattgatttatcagcagcatgttggaagccgacagttaaagcacgaacaacataggttaatacttgacctgctgcggctaacggaatagcaattgcgataccggtgctaatatcttgtccaccgacaataactaagattgttgaaacaacggaggctaaagcggcatccggtgcaagagccgcaccgatattcatccaacctaacgccaagagttcaagtgaaccgcccacgataatccctgtttttatatcacctaagactaaaccgattaatgtacaagcgattagtggacgatgtgtttgaaattcatcaagaattgatcccataccagagatacaggcaacaataaagacaagtacgacttgtaaagttgaaatttccatttatgtcttccttaaattaaattattttttttgagtaaatccatcatatattgacgactgtcgttagatactttacgaacatctaattcaatgcccatcgcatcaatggctttgaatgcggcaatatctttatcatcaacagccaccgcactcgtaatcatttttttaccgtctttatatgccataccaccgacattaattgatttcatatcaacaccggcttctaacaatcttagaacatcggtaggattagtgaataatagcatcatacgttcatttgcatattcaggattgttatatacacggatcattttttctatattcacaacatgtgcggtaactcctggaggtgcaacgcttttcagcatggttgagcgaacttgatctttggcaacatcatcattgactacaacaatacgtgttactcgactttcttttgtccagcgagtggcgacttgtccatgaattaaacggtcatcgatgcgagctaaacccacaatgagattgccttcttgttgtttgactgcgatttgaggttgttcagggacaggttgtgaaagtgcggtagtttcagcagatttttcttcatattttaaagcacgaacaccagcacggccggtttctaacgcaatgctcactaattcttgtaagctagggttatcgtcacgtgccataaaagtttccactaacataggcacatttacaccggttacaatatccatattagtgttatcaccaattacacgatttgccgcattaaacggactgccgccccaagtatccactaaaaacaggacttcatcgcaatgtgctaatgttgtacttaatttttcttgatacttcgtcataatcgtttcagcgttttcgcctgaaacaaaatcaatagttgcaacattctcttgctcaccaatcaacatttctgttgttttaagcaattgttcagccgcaacaccatgcgttgctatgataatcgcaatggacattcggactccttcctaaaagtattaaattgatttaaagggcgggtattataaaggaagttttattttaataatgtgatacagatcacattttaagatgttttttgggtttaaagtgtgatgtaaatcacgctgattgcaaaaaaaagtcaaataaatgtgatttagttcactctttactcgacttattcaaaaatgcacaaacaatcaatttaacgtactttagcaagattgtttttttgagtttttaataattcagcatgtgctttcttttgctcttttattttattgttaatttctctacgctgtttagacagttccgcattacgaattgtataatcgtcaacccgagtttcgtaatcatcacgcatactttcaataatcgcacgcacatcagcaatactcatatcattacggatatattgattcagattatccaatagcaacacacgcttttgattatcacgaattttacgattattgtcgtctatgtcgcgtaaaagtttgttttttaaccgatacatacgtacatactctaaaacttcttggaaagattgtttattgatattttccatttttttcttctcttttattaaatgaaacttcggctaatttaactttttttcccttattcgtcaaagtgttctctaggaattttcttgagctataaaaaattcagaaatttattaaaagttagttgattaagctgtgacgagatgatagaaattaaaaattctttttataaaaccaattaggataaaaatatgatgcaagtatttaattttagtgcaggacctgcaatgatgccaaaagttgttttggaacaggcacaacaagaattgttgaattggctggatcagggtacttctgtgatggaagtcagccatcgtggtaaatattttatggaaatgattacacaagctgaaaaagattttcgtcaattgtataacattccggaaaattacaaagttttatttttacaaggtggggcaagagggcaatttgctgctattcctatgaatttagctaataaaaaaggcaaaacactttatcttaccagcggacattggtcggcaactgcggctaaagaggctcgtttgtttacagaggttgatgaaattaatattttacttgatgggaaattagaagtaggggaacttgattttagccacattgcttcacaatatgattatgttcattattgtccgaatgaaactattagcggcgttgagattgttgatgtaccaaatgtaggtgaggcgatattgattgctgatatgtcttctaatattctatcccgtgaaattgatatgagtaaattcggcgtcatttatgccggtgcacagaaaaatctcggtccggcaggtatcactattgtgattgtgcgtgaggatttaattggtcaggcaagaaaagaaacaccgtcaatttggaattatgaagtccaaagcaaaaatagttctatgattaatacgccgccgacttttgcttggtatctttgttctcttgtattcaagcatttgcttgcactgggtggtgtcaaagaaatggaaaaacgtaatcaggaaaaagcaaaattattatatgattttcttgatcagagtgatttttatcataatgttgttgcacctaaaaatcgctcattaatgaacgtaacatttaccacaaataatgatgaacttaatgcgaaatttgttgcagaagcgacagcttgtggattgcaagctttaaaaggtcataaggtattaggtggaatgcgagcttcaatttataacgcaatgccgattgaaggcattaaagcattaattgaatttatgcgtaaatttgaagcagaaaataactagaattttatagcaaaaacgaccgcactttaacggttattaatttcaaataaggatttttatgcaatacatcaacatcgccaacgaaggcgtaaaatccctgtctccttaccaggcgggaaaacctattgaagaattagaacgtgaattagggattagcaatattgttaagcttgcctcaaatgaaaatcctttcggttttcctgagagtgctaaacaagctatccaaaagcagttaaatgatctcacacgctatccggattccaatgggtttgaacttaagcaagtgatttcgaaaaagttcggtttgcaaccagaacaaattactttaggtaacggttcaaatgatttattggaattaattgcccatacttttgcttcggaaacagacgaaattatttattcgcaatatgcttttattgtctatcctttggtgacaaaagcgattaatgctgttgcacgagaaattccggcaaaaaattggggacatgatttagacgcttttttacaggcgattaatcataaaacaaagttaatttatatcgctaaccctaataatccgacaggcaattttttgactgaacatgaaatagatcatttccttgctcaagtacctgaaaaagtgcttgttgtgctggacgaagcctatacagaatttacagatgaaaaagagcggttaaattcttttaaacttttacaaaaatatccaaatttaattgtttctcgttcattatccaaggcgtatgggttggcaggcttgcgtatcggttatgcggtatcgaaccctgaaattgcggatttacttaatcgtgtacgtcagccttttaattgcaatgttcttgctttagtttcagcggtagccgtgatgcaagatgatgcttttgttgaaaaagtggctgaaaataatcgtattgaaatggttcgttacgaaaatttttgccgacaacaaaagttagattatattccatctaaaggtaactttattactattgattttaaacgtccggcaaatgaaatttatcaagcattgctacataaaggggttattgttcgccctattgccggttacggtatgccgaatcatcttcgcgtcagtatcgggttaccgaaagaaaacgataagttttttgatgcattagtaaaagtgttaggcgaggtctttgttgggtgaagaaaagtaatttatacttttgcaatatccctatttacaacttaagaaagcaacataattttatggaaaaattaacgttatctccaattagtcgcattgacggcgaaattaatttaccaggttcaaagagcttatctaatcgagctctgttattagccgcacttgcaaaaggaacgacacaggtaacaaatttattggatagcgatgatattcgatatatgttgaatgccctgaaagcattgggtgtgaattaccaattatctgatgataaaacggtttgtgttgttgaaggtattggcggtgcatttcaatggcaaaatggattatctttatttttaggaaatgcagggacggcaatgcgtcctttagcagcggcactttgtctaaaaggtgatacggagtctgaggttattttaaccggtgagcctcgaatgaaagagcgtccaattaaacatttagtcgatgcgttgcggcaaaccggagcaaatattcaatatttggaaaatgatggttatccgcctcttgctattcgtaatcaaggtattttcggcggtaaggtacagattgacggatctatttcttcgcaatttctgaccgcacttttgatggctgcccctctcggtgagggggatatggaaattgaaattttgggggaattggtttctaagccttatattgatattacgctggcaatgatgaaagatttcggaatcaatgttgagcattataattatcagcgttttttgattaaaggtaagcaatattatatttctccgcagacttatttggttgagggggatgcttcttccgcttcttattttttggcggcagcagcaattaaagggaaggttaaagtaacgggaattggcagaaattccattcaaggtgatcgtttatttgcagatgttttggctcaaatgggggcaaaagtaacttggggagaggattttattcaagttgaaaaatcagagctaaaagggattgatatggatatgaatcacattccggatgcggcgatgactattgcaatcaccgcactttttgctcagggtgaaacggttattcgtaatatttacaattggcgtgtaaaagaaacggatcgactaacggcgattgcaactgaattgcgtaaaatcggtgctgaggttgaagagggggaagattttatccgtattcagcctcttgcattggataaatttaaacatgctgaaattgctacttataacgaccatcggattgcgatgtgtttttcgctcattgcattatcagatacatcggtaactattttagatcctgtatgtactgcaaagacttttcctacctatttttccgaatttgagaaaatcagcaaaaatcaatagcttaatgggcaatttattgcccgtttttttataattaaattctatattcaatttgtgtaataagtaaaaagtcattaaaatgggcgagtgtttattcaattcttgtaatattttattcgattatcgaaaaaaatccgctttgtgtaattactacgccggaggctgtaattcagtatggtgatgaacattttttaatgttaaagattttatttttttccgttaggagttagtcctcatgagtattcaaactcacataaaagcaaaacgttctcatgtgtttttcttaaaactgtttttgggcatcattgtgcttttatttgtcgttatgatcggtttaaaagttgcttcaaaaatgcttattggcaagatgatagccggtatgcccgaaaaaacgacaccggttacggcaattacagtagtaccaaccacctggatacctgttatcgaaacaacaggcttggtgagacctaatcaaggtgcggttttgagtgcacaagcaccagggactgttgcaaatatatttatccaatcaggacaacctgttaaaaagggagatgtgttggttgagttggatatttctgttgaacaagctaatttacaggcatcagaagcaaaattaaccacagcaaaacaaatctataaacgctatctgaatttgtataaaacgaagagtgtttctcagcaagaattggataatgcaaaagccaattatgagtcgttggtagcaaatattaacgccttaaaagcagcaattgagcgtcgcaaaattgttgcaccttttgacggtattacaggtattgttaaagtgaatgttgggcaatatgttaatgtgggaacgcctattgtacgtgttgaagatacaagttccatgaaagttgatttttctattgcacaaaatgagttggaaaagttgtttattggacaaaaagtgacggcaacaagtgatgcacgtttaggtgaaacgtttggtgcaaaaattaccgcacttgaaccagcagtgaatgcagcaaccggtttaattgatgtgcaagcaactttcgaggatgaagacagtcgtaagttactatccggtatgtttatgagattgcgtgttgcattgacgaccgaaaaagatcaaattgttattccgcaagtaggtattagctacaatatgtatggtgaaagtgcctatgttttgaccgcactttctgaggaagacaagaaaatattacttgataacgaaaaatttgcttataaagacagtatagacagggtttatcgagtaaaacaaactactgtatttactaaagagcgtcaggggatttatgcacaattaaaagggcaagatattaagccgggtgaccaaattgtggttggcggtcagcaagctattaccaatggtagtttagtggtggttgttgataaagaaacaataggcacaaaacaacctgccaagaaaactaatctttaattttaggtaggaatatatccaatgaaatttaccgatatatttattcgtcgtcccgtattagctgtgtcaatcagtttgcttatcattattttagggttgcaagcaatttcaaaattgagtgtacgtgaatatccgaaaatgacgacaacggtaattactgtagcaacggtatatccgggggcagatgctaatttgatgcaggcatttgtaacctctaccttagaagaggctattgcccaagcggataatattgactatatgtcatcaagcagtgcggctaattcttcgataattacagttaaaatgaaactgaatacagatcctaacggtgctttagctgatgtattggcgaaagtgaattctgtgcgttcaagattaccgcataatatagaagatcctgtgatttcatcttcaacaggtggtacaggaattatgtatatcagtttttattctgataaattggattccagtcaagtgacggattatatcgaaagggttgttaagcctcagttatttactgttgaaggggtagcgaaagctcaaattttcggggcggctcaatacgcattgcgtatttggttggatcccgaaaaaatggcggcacaaaatctttccgcactggctgtaatgtcagctttatcggctaacaatgtgcaaacagcggctggaagtgcggatggttattataccgtttataaaaataaagtcgggacaaccactaattctgttaaggatttagaaaatttaattgtttattcaaaagacgataatcttgtacgtttgcgtgatattgctactgttgagctaaataaagaaagtgatagtacaagagcaacagcaaacggtgctgattctgtcgttttagctattgaaccgactgcaacagccaatccattaacggtagcggaaaatgttcgtccattgtatgcacaaattaaacagaatttaccaagcagtatgtattctgatttgctttatgatcgtactatcgctatcaatagttctattaatgaagtgatcaaaactattattgaagctactgttattgttttggttgtgatcttactatttattggttctttacgtgcaattttaattcctattattactattccaatttcattaattggcgtaatcatgattttgcaattatttgatttctccattaatttgatgacgctattggcaatgatcttagctattgggttagtggtagatgatgcgattgtggtattggaaaatgtggatcgtcatattaaagccggtgaaacaccgtttcgtgccgcaattattggtactcgtgaaattgcaatacctgttatctctatgacaattgcattgattgcagtgtattcacctatggcactaatgagcggaattacgggatctttatttaaagagtttgctttgacactggcaggtgcggtctttatttcaggcattgtagcattaactttatcgccaatgatgacaagtaagttactaaacaataatgcaaaacccaatcgtttggaacagcaaattgaaaaatcattaactcgattaaccaatgggtatgtttatgttttaaatttagttatggataaccgtaagtgtatgcttgcttttgctgctattatttttgccatgttaccatttttgtttacttccctttccagtgaattgacaccagcggaagataaaagggcatttatcgctattggttccgcaccttccaatatgaatgtagattatgctcaggaggcaacgaaacagtatgttgatctgctgaacaaaaccgaagaagtacaatttacaatgtctattgccggttttccaagttctagcgatacattaaatgttgtaaccttgaaagattataaagaagatggtcgtagtcagtcagagattatagaagagttgaatcgaaaggcaacgcaaattccggaagtgagtgtttctgcctttaattttcctgaaattgatacgggagaatccggagcaccgataggctttgttattagtacagcaaataactatcgtgatttagcaccggttgcagaagcatttttagcgaaaatgcgtgaatcaggcagatttgtttatacgaatctcgacttaaagtttgataccgctgaaatgcaaattagcatagataaagaaaaagccggaagttatggtgtttctatgcaacaaattagtagcactttagggagctatttatccgcagctacggtaagtcgtgttgatatagacgggcgagcttataaggttatagcacaagtcaaaagagcggatcgtttaacaccggaaagtttgaaaaatttctatgtatccgcaagtaacggaaaaagtattccgttgagtagcttaattagcatggaattggtaacacaaccgacatcattgtcaagatttagtcagttaaactcggcattaattcaagcagttccaatgccgggagtttcagtaggtgatgcggttcaatggctgaaagatgcagcgacggagttactgccaaaaggatataactacgattttcgtggcgaagcacgtcagcttgtacaagaagggaatgcgttagtaataactttcgtgttagctgttcttattattttcttagtattggcaattcagtttgaatctattcgggatccattggttattatggtttctgtgcctttggcggtaagtggagcgttactggtacttaacttcttgagcttattaactgatatgagaattttagggttatcaggagttaccctgaatatttactcacaagtaggattaattacactggttggattgattactaaacatggtattttaatgtgtgaagtagcaaaagaagagcaactttatttgggtaaatcacgaattgatgccatcactgaagcggcaagagtgcgtttacgccctattttaatgacaacagcggcaatggttgctggattaattccgctcttgttggcatcgggagccggtgcggcatctcgttttagtattgctatcgtattagttgcagggctttcaataggcactttatttacgttgtttgtattgcccgtaatttattcttatattgccagtgaacacaaacctttacctgagtttgatgaaagtataaaaccattggcgactgatcagcatcattaaattcaagcgataaataaccgcacttttaagtgcggtttattatttcaactattttatttgcaaacgcaattgggttttctaaatgagcattgtgtccggcacgttcaattaaaaataaatttaattgattttcttgtgccatttgcttaaatttttcatccttttcaccacagaaataataaatgggcagagaaaaagaccgcactttttgatgaaaagatggttgtttggcaagtgacgttgcgattagcatttttgcaatattttgacctgattgatgtcttcgttgagaaattaattgttttcgctctcgtgcagataggtgagcaaaaacaggttgctgataccaatcatttaaaaccttggacatagtttcttggctaaaacgttttgcccaagccaaatcattctgccagcgttcaaggcgttgttgttcattttctacgcctaaatttgcaccttccaagataagtgcaacaagtttactttgtggatatttagattgcagtgcgtaatttaaggcaagacgtccccccaatgagtaaccaacgagaatataaggcttatcggcaatttttgcggtaatttgtcgggatagatattgtgcactttgttcaaaatcttctatgtgatagtttgtttgttcaccatgaaagggcagatctaaacatagataagattgtgaggaaaagtgcggtagattttttttaagttcttcgataatgtattgccaatcttgttttgttccaagtaatccatgtaaaaaaactaagatcggcatcatacgctatacctcttaaacaccgattaatgcatgaccaattttgtcaataagatctttatagatattgctaccgtcattcggattgactttaatttcgatgatggtcgtttctctgcgtgagtaggcttgtttaagtaccgtagccagatcagcccaagtataagggcgagcatatttgagatcgaacatagccgcaatatgtgaaaactcaagatagtgcgacatacggtaatatttttctttcactgcgatatcaacaggaagcatatcaaagattgctccaccattgttattaatgacaaagataattgccggttggtttagttgtttgaataatgcaaaagagtttaagtcgtatagcgtggaagtatcgccaatcattgctaccagtgtttgttcggaaccaacagcaattcctgccgcagtcgcaagcaaaccatcaattccacttgctccacgattagtgtaaattggataattggcggaaggttggcttagtgcatcggcaaggcgtacaaataaactgttccccaaaaagagaacgctattagattttggtagtaataattcaatattatgtgccaatgaggcctcatttaaatttgaaccgacacgttgtttgataaagtccgcacagaatttagccaatgctaaaggctcaagtaaccaaggttttttccgcattggcggatgggctcgtaaccaatgatgcggtttagcattgaaacgtgtatgagcatgatgatagggatcaacagctttttgattattttcaataatccagtattcacctttaaattctgctaagaattgattaattcgctttccaataaatcctgagccaaattgaatgacgatttcagcttgtaacagtttttttctgacagtttggtttgccagccaaatatctgcataaggtagggttggtttaacatgggattgaatgtctgtaatcattatccaacccatattgtctgcccattcagcaattcccattgcctgttcggaaggtaagcgtccaacaataattatgccttttttggttcgccattgatcccaatatttatgtgtaataacttccgtgtgttgttcttgatgttgaatccaatttttgttttgtgttagccaagattgaatattactgagccaaggatgaagatctatttcatcattattggcattatagagcggttcagcaaaagggacattgatatgaataacgcccccttgcttttgtcggaaacaagcctgatctaaaactgaaattagccattgagcagaatagttttgacttggacgaggcagatttatgctggcgatcgggtattgtgcaaacatattttgttgcaaaatagcttgattagcaccgcactcaagcaattcaggaggacgatctgcagttaagataattaatggcacatctgtttggcgtgcttcaataattgcagggtaaagattagctgttgctgtaccggatgtaacgattacagcaaccggttttttgctcgctttagcaattcccaatgcgaaaaatcctaagcctctttcgtcgaaatgagcatgacaggtgccacgtccattttcctgtaaacggatagcttctagtgtaagtggtgtggagcgtgaacccggtgcaatgcaaaaatgagaaacaccttgacggctcaaggtttccaaaatcacttttgaccaacaacggttaaaaacgctggctgacatattttctactccgtttctttctgtaatagggatattagccctagtgctttacgttctatttcttgccattctaataaaggaatagaaccttcaacaataccggcaccggcaaatatacgaatataatcttgttcaataaatgagctacgaatagtcacacaaaactcagattctgtttcagtcattattcccaatgcacctgcataccaagtgcggtcaaaagtttcggtattttgcaagaacacttttgcttctttttgtggtaaaccggcaatagctgcggttggatgtattgcatttaaacataccgcatcagtatttcctgctttaagtcgggcagaaatttctcgttttaaatgttgaacttggcgtagttgcttaatttccagttcactcaccgtaatttcctcaacatagggtataagatgttgacaaatgccctctacaaccaagctgttttcataaatatttttcggatcttgtaataaccactgagcttgttgctgattaatatgttcatcatttgttataaaagctgtccctgccaatgcttcagtgattaggcgattttgtttacgaacatataatctctcaggcgtggagcctataaatgcttgtgtattattttgagcaaacaaaaaatgatagcaacctgtattgtacttctcactttcggctaagaaatccttagcgtttaatgggctatcagttttaaagtcggtttcatttgccagcacaactttagtcagatttttttgcttaatttcatgcaatgctttttctacccaaagacaccattccgtttgatttgcttttgttgttatcaattgaattgattgatggattgggtttaattgaacttgtttttccaaagaatgaataatattcaacagatcatatttttcttgttcccaaggttttttattatcaataatgagttgaataacaagtttttgttcttgtatgaatgataaacgtggcaaaataaatagaggttcaccattaaattgacagccgccgataagagataaattaaattgttgcacaaacgttagtgctgatttaacttgcgtaaagcgacatacttctccaagccctaagatttttttattggtatcacgaaaattaagataaaattgcggataatgatgttgagcttttaaccaaccgagtaaattcaattcttcatttaaatccaaacgaagaacggaaaagtcgtttttagggtcaaattggtattgattaattaagcgaataaactcagccttaatctcgtgcaaattatccattttgtatcgtattaagttaaacattcagttaaaaacagctcttaattctaccgcactttaaaaattttttttataaaatcttttcatctttttaaaataagcgtaaagtgtggctatattttgagtgacattattattaaaaggatagtctatgcgagttttccctaaatccgataagttagaacatgtatgctacgatattcgtggaccggtacatcaagaggcgttacgtttggaagaagaaggcaaaaagatcttaaaattaaatattggtaatccagcaccattcggttttgaagctcctgatgagattttggtagatattttgcgtaatttgcctgccgcacaaggatattgtgattcaaaaggtctatattctgcacgtaaagctattgttcaatattaccaatctaagaatattttaagtgcgaccgtaaatgatgtatacatcggtaatggtgtttctgaacttattactatgtcattacaagcattgttgaatgatggtgatgaggtgttaatcccaatgcctgattacccattatggacggcagctgcaacgttagccggcggaaaagcggttcattatttatgtgatgaacaagctgattggtttcctgatgtggcagatataaaaagtaaggttacttctcgcacaaaagccattgttattattaatcctaataatccaacgggagctgtttatagtaaagaattattattagatatagttgaagtggcccgccaaaatggattgatgatttttgccgatgaaatttacgataaaattttatatgacaacgctgttcatcatcatatcgccgcattagcgccggatttgttaacggttactttcaacggcttatcaaaatcttatcgtgtagcaggatttcgccaaggctggatgattttaaatggaccgaaacagcaagcgaaaggctatattgaaggtctggatatgttggcctcgatgcgtttatgtgccaatcatcctatgcaacatgctatacaaacagctttgggtgggtatcaaagtatcaatgaatttattttgccgggtgggcgtttattggaacagcggaacaaggcttatgagttgattaaccaaattccggggttaagttgtacaaagccaatgggagcactttatatgtttccgaaaattgatactaaaaaattcaatatctatgatgatgaaaaaatggtattggatttattgcgtcaagagaaagtgttattagttcatggacgtggttttaactggcaacaaccggatcattttagaattgtaaccttgccttatgtgaatcaaattgaagacgccttaggaagattagccaaatttttaacgcattatcgtcagtagttgtgaaacaagagagaccattttgctctctcttgttttgtcttttaaccttcttcacaaaaattttcaggtaaatttgtcagtattcctttccaaatagcactactacgttcacgattttccacaagataaacactggcttgttgataatctccatttcgacaacattctttcaattgttgatagaaagtgagttcaacttggcgtgattgcggattaataaaaaaaagtgcggcgacttgatgataaagtgttctaaaactgtttaaaatcaaagtatatacgggcttatccgatataaagctaaaacgatgatagaggttatagtcaaattccgcataactcttttcatcatcatctaattcatctaaagattggaaaaattcaaacgtttgttgaggattaatttttattgcttcaggaataaattgttcacccattcgagtacgtaaagataccacatttgcaatgacggtaggtttaagagtaggtgataattgaatgagtgtttttaaaatattgggaccagctgtttcccaaatattgtttactttagttggtttaccatgttgaatatttagccaaccatcacgattcaaacgctgtaatacttcacgtaatgttgttcttgttacaccgattttgtctgctagtttacgttctgcaggtaaatctgagccggcaggaaaatgattattccaaatgcttttgacaatatattcttcggctaacgcagccggactttgtgctttaagaatatccatacttctctttttgttaaacatactgtaataactaggtgggcattatccttgaaagcgatttatattacaatcatttaattatgttttttgctttcctttataagtgttttattctatattactcgtgcgtttgtatttttgtgttttgagtttttatgaaattaatttgatgacattaaggatcataggcatgctcatcttttttaaaaatttatcaatgaaacgtagtacttggatactgctgttcatttcagcattagtgttagaaagtaccgcactttattttcagcatggcatggggctgaatccttgtgtgatgtgtatttatgaacgtgtagctattttaggtatcatgttttcaggattgattggatgtattgcaccaaaatggttagttttacgcattttagctttacttattgggttaggtagtgcggtaaaaggattattattagcaatcaaacacttagattatcaacttaacgtatacccttggaatcaatgtgcaatggttcctgattttcctcaaaccttaccattggataaatggtttcctaatatatttatgccttcaggttcttgcagtgatattacatggagttttttaggattttctatggtgcaatggattattgttatttttgcatgttatttcctatttttcattattctcagtataagccaatttaaaaaagtcagaaaaaacagaatgctgtttagatagctctgctcgttgaaatttttctcaaagtgcggtgttaaaataaattatttttgtaccgcacttatgttattaaaaaatcattccttaaagcttacttgttcctagcgtgaattcctcttctttagggggattagacgtagggaaaatcaagatttaataaatcttatagattattttgtgtctaagatctttagcaaaacgctttaacttacgtataaacggtacgttttcaactttccattcttttggtggattttcaagttgctggaataaatgacaaaataaattcgcttttagcattgaacatttttcatgccatgatttttttggaccaacataatgaataatagcaagaggcatagtcgcttcttcatattgattccgttcttttttacttaccctttttagtctatttaacgcattggcagtaaaattatatcttaagtctaaatattttacattattcgcaaaaatagcatttaaaatatcctgatcttgatataaaaattcaatattattacgtttacaatattcaatccattgtaatgatttttcaaaaacatgacatttttcccattcaactacattaattaataatacgccggcattaaaataaaaatgtgtattaggtagatgaagttttgttttataatctgactgactgactgactgactgactgactgactgactgactgactgactgactgactgactgactgactgactgctcattcttttgcttttttcttgggattcaataaaagcatcataacaagctccgattgccttgtttcctaaatcagtattccacaacggcaacagactatgattgaccaatatgtcaatatccaaataaataattttcgttaaattaaatttttttaaataacttgctagatttaacctggcgtaggttgataaagaaatatattctattgttctaggaaatttttcaaaatcacttatattaataggggtaatatccaaacgacagttgtttttattggctagttcaatgcaataatcctttgcaacagtagaaatacccatatccaacaaataaaaatgaatagtataacactcattgtttttatctctagcgtgaataatacttaacatagttactgctaaatattttgcataattgtcatcacatgaaaagagaatgttcatttgtttcttcttcttattaaggattttaatgttttactcagtatttttcttttttgtaataaatttaaatgtttatattttaaaatatataagagaaattcaatagagccacaattttgataaattaaatttagtatcatattgaaaagaacaacattaagcgatttaaaatcacttgctggtaaaatattttttttagatgaaataaattcggcaaaatcagataaatcattaaaacaatagttttcttggaaagagtagttaatgcctaatttttgtaagagaaagttggttgcttctattcttattcttctagctgatttttcttgtatatcactatattttgaagatatttgattatggtgtaccctatagtaagtaaatgattgagggatatttgccatttttcctcttttaagtatttctagccataatttataatcctctgcatgcggatatttttcatcataaaagagattatatttcttaaaaacatcgtttcggattaccatagtgggatgagtaaattgatttttaaatggaaattctcttaaaatttcttcatattctaaacagcctttccacacatctttatttttagtatattttcccacttttccaagtggaacatcattatcatgcaatatagtaataaatccgccaacagcaagcaaatccggttctctttccattttttctacaatcgtttcaatccaaaagggttcaacaatatcatcagcatcagttcttgcgacatattttccattacaatatgttaaacctttattaagagatttaataagtcctaaattagtttcattttgtaatactaataattcccccccctagcgtattcatgtgataatctatttaaaatttcctgagtattatcagtagatccatcatttactacaattacttcaatattattataagattgaagcataattgcacgaatacattcttctatatatttttctgcattatatgctgaaatgagtacagaaactaagttattcattatttttaacctctctataagaattttacaatacgccaaccattcaattttctttttaatcttcttctaaatcgtcctatttccttcgaaatacttcgccataaattccttcttgcttttttattattttctctctctctctctctctctctctctctctctctctctctctctgcacgctctactgaaataacgctggttaacttgcagttgttttgatttaaaacattatcttgaataacaattgcaggagaaatttgataaacgggatattgttcttcttttaataatgattcaaataaaataacatcaattggctcaactgaaaaataaggagatttaaataaatctaataaattttttgcggcaatttgtgaaataatatatcctgcagttccccattgttgagacattaattgaggaaaacaacgctgttgaaaaaatttaattttagttttgcgatatgctgaattcattaaataagtttctaaacgaagaataaaatactgattcacatcaaaccgctcttttaaccaatcatattgaccaagaaattgatgggcgactggactgagaataatgtcatcttcaaaaatagcgataaaaggtaaattttcatcaatacatttttgccataataacacatggctcataaaacagcctttttctcctattgtcagatcggttttatttaaggaagggacatattgttgaataatatgttcattttcttcattaggttgaaacgcattaaaaaaggaatatggaatattttgttcgccaaaatatttttcaatatgttgacgtctttcaactgaactttttaaactgataacatgattaaacattatatttcctaaaaataaaataacgtattctaacaatgatatgctatgtgcagagatattattataagaattttatacgacgataacctttcaatatccctcttctaaatcgccctatttccttcgatatacttcgccataaattcttttttgcttttttattatttttactctctctctctctctctctctctctctctctctctctctcgggtgcaagagaactggttaatgtgcagttatctttatttaaaatacaatcctgaataataatggcaggctcacattgataaaccggatattgttcatcttttaataattgcttaaaaataatttgatctatttcttcaatgaaaatatccgtatttttaaataacgctaataattttttagctgcaacttgagaaagaatatagcctcccattccaaaatgtccagacattagccgattaaatttacggttttggtagtcgggaatttttgtcttgcaatattctgatttcatataaattgtttctaagcggagaataaaatattgattaaaagcgaaccgctcttttaaccaatcatattcactcaaaaatttattggcgaccgaactgagaaaaatatcatcttcaaaaatggcaataaacggtagattttcatccacacatttttgccataataaaacatgactcataaaacagctctttagtttatttgcgagactgcttttacttaaagctgggacatagtgttgaaggatattttcgttttcttcattaagttgaaaagcatcaaaaaaagtatagggaatatgttgttggctaaattctttttcgatatgttgacgtcggtcgaccgcactttttagactaataacataattaaacatagtttactcattttttatatataaaatgtagtggtttgctacccaattaaattgacagtataaaaaataatttctaaaatagccaatattttgttgagtttactgtgaattatgttagataatgccaatcaatcaatcaatcaatcaatcaatcaatcaatcaatcaatcaatcaatcaatcaatcaatcaatcaatcaatcaatcaatcaatcaatcaatcaatcaatcaatcaatcaatcaatcaatcaatcaatcagcgatttttgtcataaatttagaaaaagcaactgaaagaaaacattttatttcccaccaatttaccgcacttcaagaacagcatcctgacatcgtaataaattatcagttttttacaggggtaaatggaaacacccaaccaaatcatcctttatttgctaaatacaatcaaaagaaacgctatcagcgaaagggaaatgaaataactttagggcaattaggttgctatgcaagtcattatttactatgggaaaaatgcgttcaattacaacaacctattattgtattagaagatgatgctattttgcagcccaattttttagctgtttatcagttctgcttttctgcggaaaatcaatttgaatttttttggttaacgcactctaatagttcaaaaattagaacaaaattaattcacacgttacccgatagtacaaaattagaacaacattatttcggttatagtaacacgacaggttattatcttactcctcaagcagcacagaagtttttagagcattctcaagagtggatctacaatgtagatatttttatggatcgtttttatgaaaatcatgttgctttattgggcgtgaatccgccttgtgtcaaacccgatttttctaagcaaagccagattacgatgaataaaaacaaccgcactttttgggttaagttaagacgtgaatattttgcacttcttgagcgtatcaagcgttttgtttattggacgttttattgttgatgatagatatggataaagtgctaggtttacgagcagacaaaactggaaacaaaataggcagggaaattattagagtttccagttcaaattgatctgacagtcagctgttaaacagagactgtcagattagttgctttttattcttgtttgtttagtaaaaatacgccattttcactaaaatgaacgtaggcctcgtgcatttcttgtgaaaaattctctgggttagtattgattagtaaatctttaccgccccaattagctatgatttcccaataacttcccatatagaccgcactttttatgatgcaatgttgttgagcaagaccttctgattttagtttgactgcctcaggacgaatacccactaaacattctccatcgttcaaagcgaatttatccgcatcaggtaaaacaaattgatagtcgttaatggtaattttgccttgttctaaatagccattaaaaatactactttctcccataaaacttgctaagaatagtgagttaggatatttgtaaagctcttttgccggtgctttttgcatgattttacctttattcatcacgatgacttcatcagataccgcaaaagcttctgtttgatcatgagttacatataaagaagtaatatttaaacgctgttgtaattcacgaattttttcacgcattgaacggcgtaaattggcatctaaattacttagaggttcatcaaataataacactttcggctttaatactaatgctcttgccagtgctactcgttgttgttgtccacctgaaatttgatcgacatagcgatcttcaaatcctgccaagtcaactaattctagtgcctcttttactctttgtttgcgttcatcagaacccacaccttgcatttttaagccatagccaacgttatcgccgatggacatatgcggaaacagtgcataagactggaatacgatacaaatatcacgattttggatggaagattttgttacatcttcaccatcaataaaaatttctccctcggttggactttcaagtccggcgactaaacgcaataccgttgttttaccacaacctgacggtcctaataaagttaccattgaaccacgttttatgctcaagtttaaattatctattactacagatttaccaaacgatttggtgatatttttgagtactaaaaaatcattattcatatttatagcctttcgttaaaattttttatttttctaccgcacttcgctattcaagtgcggtaccgattaattcatttttttcgcttttgaacgggaaatgcgagtgtcaccaacgatccagtcaaagaataaaataattgccatcattacaacaattaaaattgaaccataagcaatggctatgccatattcgccatcttcaactcgattcaaaatataggcagtagctactcgtgtatccgctgtaactaaaaaaacaatcgcactgacggttgtcattgctctaacaaagctggtaaccaatgcggaaagtaatgccggttttaataatggaaaaacaataaataaaatagtttttaatgaactgccttttaaagaaagtgaagcttcatctagagatttatctaattgtccaagtcctgcaaccgccgctcgcataccaacgggcatgttacgcattaccattgaaagaataataattagtcccgtacctgtaaggtaaatcggtgcatcattgaatgcaatgatataagaaacaccggcaacggtacctggtacagcaaagcaaagtaaggttaagaattctaaggtttttttgcctttaaaatctcgtcttactgtaatatatgcgatgagcaatccgaaaatagccgtaattggagccgcacttatcgcaaaaataaccgtttgaattaatgacggccaagcaccatcactgaaaccttgaccaaataacgttatgtaattttgtagggtgaacgtgtaatcaacgccccagttttttgtaaagctaccataaaaaatactgccatataagaccgcattaaagaggatccaaaaacctaacgtaaagacaacgatatattttaaggtcgttggtaattcttgtacgtctcctcgataggattttcccgatactgttacataagaacgattacctatccaccaatattgaatgataaagattgcaagagaaaatatgagtaatatcgtacctaacgtgctggctgaagcataatccaattgagaacccgcaatgtaaaaataaatttgtgatgaaatcacatcaaagctaccgccaagaactaatggcgtactaaaatccgccaatgattgaattgccacaactaagaatgaatttgctaatgctggctttaacaacggaaaaataatattaaaaaacgtttgatagcgatttgctcttaatgtataagatgcctcttcaatagatggatggatagattttagtgcaccttctaaaatcataaatgacatgggagtaagtgctaaagtatgagcaattacaatacctgtaaaaccatatagccagttactgctaaacccaaaatactcaactaaaaatgaagttacataaccggaacgtcccaacattaatgttaccccaagaccgactacaaaaggtggggtaacaataggtaaaatagagaatattttacctattaccgctgttcgcttagcaactctggtagtataaagtgcaaaaattaacccaaataatgtcgctagagttccaattgtaaatgcaaccgctaatgagtttccaatgatgcgtaaaacatagggtttactcacaatgtccaacacttggccaggtacaaatgtcgagccatcgtagaacatagaaaggaaaatggcgaaagttggataaacaataaagaaaaatataagtaaaatgatacttattagagaaaatataatgaacttatctccttgcataaatttcatttttgccaatgcgttggttgctaatgcaaccaacgtaataaccaagataaaaatggaatatccaagactgaacttttgcaaaatagcagacaaaaatacaaaaaagaagattcctacaacagcaaaaaattcaacttttccttgtttttgttccccgctatgttgaaataaatgagaaagtattggcacaatgagtaatgaaccaaaccaaagccaacttaaattaaacttagtccatcccattgcgtcataaatttcttcagatgtagaatctgttataccatagtgtaatgtcatagttggtaacacaaaaaatccaataaacgacaataaaatccatcctaggctacctttgaatattcgtgtctgttcactcataaaacctccgtgaaacaaaaattactttgctaatttaacttctgtaacccatttatcaataatcttgctgcgaacttcatttgatccaaatcgatcaaaatcataatcgattaagtttaattccgttggcttaagtgaataaggcgatggttcagcattagcattagttggaatatgatgggattgtgccttttgccaagaaagttcttgagcttcttttgacattacccagtcagcaaataattttgcatttttcaaattacgtgcatttttaatgatactgattccgcccagttcatagcccgttccttcacaaggaacaacaagctcaataggtgctccatttgctttttcaaaagagtaattttgtaaaaagcctacacctattgctgtttctcctcttgctgtatttcttgaaggagctgtacctgctttaggatattgggatacatttcgatgaagttttttcaagtaattaaacgctgcatcttctccccataattggataaatgttgcaattgccgtgtaagcagtacctgaactttgaggatcagctaattgaatttcgttttttagccgtggatctaagagatctttccaacattttggaacttcagtaatacctaatttttttaacctttcggtatttacaccaaagcctaatactcccatgtatacaacagaactctttccatttcctaatttttggaactgaggaagcacttctgccaatttcggtgatgtgtaaggttcaatcagacctagttccaccgcttgtaagtgcgtgtcgaatggaccgccaaaccacacatcagcttgaggattatttttttccgctaccatttttgctaaagtgctgcctgaactattgcgaataaatgatgcactaacattgtatttctcagaaaaaccttgaacggctttttcacatactacattttgagcactacaataaaccactactctccctgccgattttgccaaggtttgagcgtgaaataaacttgcaaaaaataaagcggaaagagataaagcaaattttgataacttcatacttattctcctaagtaaaaaatatttttatttagccaatttaacttcattaatccattttgtaattaaacgtttacgttctgcaacgtcaccatatttttcaaaattgtaattaataagttttaatttcttaggatcaaaagctaccggtgattgttctgctgtcgtgttagttaatgtttggaatgattttccttttttccaagctaattcttgcccttcttttgataacgcccaatctacaaacaatttagcattttctaagtttcttgcacctttaataatactgacacctcctaattcataccctgttccttcacaaggcacaatcatttctattggtgcaccttgttgtttttgcaatgcataatcatgtaagaaacctattcccacagctgtttcaccacgagcggtattattagagggggtaattcccgattttgtgtactgtgaaatatttgggtgtaactgtttaaaataatcaaaagctttatcttctccccaaatttgaataaaagttgcaatcgctgtataggcagtccctgaactttgtgggtcagcgatttggatttctcccttaagacgaggatcggttaaatctttccagcattttggaatttcagtgatacctaactttttcaatcgttccgtattaacaccaaaacctaaaattcccatatagatagcagaggtataattacctttcactttagccggatcttggaaacgttctacaatgtgattaatattgtcggaacgatatggcattaataatcccatttctgctgcttgtgcttgaggatcaagcgtaccgccataccatacatcggcttgcggattatttttttctgcttcaatttttgctagagtactgcccgagccgtttcgaatgaaggatgtttttacgtcatacttttcaccgaaagccttggtttcagcttcacacatttcattagttgcactacagtagacaactaaacgcccctttgcattaacttgagtcgttaccattaatcctgttgcaaaaagtgcggttgatattgcccaagatatttttttcattttcatatggttctccttgtttgaaaaatacctgttgtaagacagtgtaggaatgataacacaagaaaaaataggatcatgtgaggaaagtcacacaatacaaaataaaagggagtgatacataaatcttctgagaatgactgtcaatacaggtaaattttctttataatcggcataaattttcatttaaattaggtggaatattatccatgtcagatcagtcttgtattattattgccattgctggtgcgtcagcatcggggaaaagtttaattgcatcgactattcatgaggaattgtgtaatgaattaggctgtgaggaaattgggattgtgacggaagacagttattacaaagaccaaacgcatctttcttttgaggaacgtattaaaacaaattatgatcatccaaattcaatggatcgtgatttactaattcaacatttatgcgatctaaaaaagggtaaagccgttgatattccagtttatagctatgttgaacatacaagaacccaagaagtaactcggtttgagcctaaaaaagtaattattttggaggggatcttgttattaacagatgagcgtattcgtcaggaggtaaatatgtcggtttttgttgatacacctttggatatttgctttattcgccgtttacaacgtgatatggaagaacgtggtcgctcattacagtctgtcattgatcaatataaatccacggttcgtccaatgttcttacaatttattgagccatcaaaacaatatgctgatatagttgttcctcgtggtggcaagaatcgagttgcgattaatatgttaaaagtgcaaattcaacatttgttaaataacaaataaggaacaaatatgagattatgtgatacagatattgagcgatatttggatcaaggtattatttctttaacacctagaccgagcaacgaaaaaattaatggtgcaactattgatgttcgtttgggaaattcttttcgtgtttttcgtgaacatactgcacctttcattgatttaagcggtcctaaagaagaggtaaccgctcaacttgatgcggtaatgagtgatgaaattattattggagagaatgaagctttctttttacatccgggtgaattagccttagccacaacattagaagcagtcaaattacctgccaatattattggttggttagatgggcgatcttcgctggctcgtttagggttaatggttcatgttaccgcacatcgtatcgatccgggttgggaggggaaaattgtcttagagttttttaattctggaaaattgcctttggcgttacgtcccaacatggtgattggtgcattaagttttgaagtattaagtggtactgctgcgagaccttatacaagtcgcaaagacgcaaaatataaacatcagcaaagtgcggttgccagtcgtattagtgaggacaagtaagggtatatctgattatgtggaaaaaaatcttcttttttattaccgctttttttgtcggcatagcaattttcacgtatgtgcagattgaaaaaattcaatcaacgttagtcgcaagattaaatgctaaccaaatagcggttgacaacattactattgattttttccctacaaagataacgcttactaatctccaatattctaaacatccttctcacattaatattgacacggcaaatattgaaataagcgtattgaatttattagcgggtaatcttgctgtaaataatattgttctaaacaacatttcccactcatatccatctttcccagctgttcagcacttaacaatgatagggaaaattacacaacaaaatagcaacattttctttgataatgtgcagctggaactgcaatttgctcaacctgtttatttggataaaagaacattcaattttcatattattgaaggattttttaatcaaaatgagatggagactcctaaatttgaaggaaatatcgtcataaatcagcaacctgtgcttattaaagcggagatctatcaatcaaaaaacgaggaaaagggactaaagattttgtttaaagctagggattgtgagcaatgtgcggcagagtttgaatataattcaactcgtgatctttcatcggtgtttacagaaggaactttgcagtttagcagtcataattttcccattgaatattggcttaaaatggcagatttagatccacttataacaggaaaagctgatattgttgcgagtggtgtagtaaaaaataatcggttacaaaaactggacatgccaattacgattaaacaaggatctctatccggcgttaatttgttggagttggcgagtgggattttacctatcaattacgatagagaaaatgcaccgagggatatggcttttgaacatcttcaactcaacgcaaattgggagaataacttattgtatttagaagatatatttattttgactgagaatattattattgaaggcaagggaatttccgatcttgatcagatgcaatgtgatattaatttagttatgcgaccgaccaataaaaaatatcaaaatgtcagtttaactgtacatttctttgatcagtgcaatcgccctcagtatcaattgaaaatccgagcaaaagattatttaaagcaattactaaaaagaaaattttcccattaagtctcatgttaatcatgcagtcttgtactgtgctgaaaaaataaactcaattttaaaataaagtgatatttactatacactttctttcttacctttataaaattattgccaataaatatcttttcaagataaaaatctaaaaacaattaaaaattggaattaaataaatatttaattatatttaaaagaaaaaattcaaattaaaatgctgaaaatgacattgacttaaccataaaatttcctcattattgggtaagtaatttatgaggaaaaagttatgtttttattaaaaaagttcagtcatcttttagcaaaatacaccgcacttgttatcattgcattagcttgtgttactttttattccccaaatctttttacttgggtaaaaggtgatgcacaaattattgtacttggtctaataatgctatcaatgggcatgaccttaggtaaagaagactaccgtattcttgcaaaacgtccttttgatattttagtaggaactatcgcccagtatagtattatgccttttgttgcaatttctattgcacaactctttaatttgtctctagggttaactttgggtttagtgttggttggttgttgtcccggtggtgttgcttcaaatatcatgagctttctttgtaaaggcgatgtggcttactctgtgggtatgactactgtttctactattttagctccaataatgaccccacttttattgaattatttagtaggtgaaacggttgcaatggacggttgggcaatgtttaagtttatgttgttagtaacattggttcctgttggtattggctcaattatgaacataacgtttgaaaataaaaaatggtttcaagagttgcgtgaattaatgccgggtgttgcggttattaactttgcttttattgttggtggcgttgttgcggtacatggaaataaatttttagaatccggttttataatttttgtatgtattgttttccataatgttattggatacatcttaggtttctttacagggcgtttatttggaatgagtacagctaaaaaacgcactttatctattgaagtaggagtacaaaatgctggtttggcaacaggattaagttcaaaatttttcccaactaatgcggagtctgctattgcttgtgcagtatcttgcgtatggcattctatttcaggcacaattttagcaaatttatttttatggtgggataaacgcaaaaatacatcaactcaaaagaacaatcctgctaaaaatttaatgaatagcacgaaataaaataataaaaatttataccgcacttgagtttgtaagctaatcaaggtaatgtatgcgagtttattttattattgttttatgaggttaatatgaaaatcattcttttgggggcacctggtgcaggcaaaggtactcaagcacaatttattacaaataagtttggcattcctcaaatttctactggtgatatgctacgtgctgcaattaaagctggaagtgaattgggacaaaaggctaaaatcttaatggatatgggacaattggtacctgatgatttgattatttctttggtgaaagaacgtgtagcacaagaagattgcgagaaaggttttttacttgacggtttcccacgtacaattccacaagcagacgctttaaaatccgttggtatcagtattgattatgtattggaatttgatgtgccggatgaagttattgttgagcgtatgagtggtcgtcgtgttcaccctgcttctggacggacttatcacattgtttataacccgccaaaagtggaagataaagatgatataaccggtgaagatttaattcttcgtgcagatgataaacctgaaaccgttctagatcgtttaaaaatttatcataataccactaaacttttggttgattattatcaagctgaagctgcacaaggtaacacgaaatactttcgattagatggtacacaaaaagttgaagaagtgagtcaagaattggacaagatcttgagctaagtgcttaaacagttcagacctctatgactacttaatactgagaacatagaggtctgcttttattcattgaatataaatatgctaattattgtgcaaccattaccatggcaggtctgataactcgcccatttaatagatagcctttttgtaaaactactgtaatttgattactttcaaacccttctgttggttgcatggaaatagcttggtgtaattcagggttaaaagtttcgccaattacaccgacaggttcaacaccgaagcgtgcaacagttgataaaagtccttttaaagttaactcaacaccatcgactaaacttttgatggtttcattttctacattagcaggagtagacagtgcacgttctagattgtctatcgtttccaacaaatctttagcaaatttctctaaagcaaatttatgtgctttttcaacatcttgttcagcacgacggcgtatattatcaatttcagcacgtgtgcgtaacaaaatatcttgttctttttttacagcttgaataagctgttcctccagttcttgcacacgagcaatagcattttccaacgcatctccattctgtatttcggtttcttccattggtttttcttgctcattttgagtttcaagttcagctgaaatttcctcttgttcgactttttcttgttctgacattatttttttactccatttttagatttgtatcattgtatcaaaaaacatagaaattaacacccgcacttattggcaagtagagtagaatgtgtgtaatatagtactccttttatttaattcaagtgttctttgtagaaagaccatgacaccagcaaattttattgatagtaaaaaattaattatttcgtttaagacgattgccttagtaggacgccctcgtcatgatgtgaatttacaaatgcacaaaaatttatttcattggctttctgaacgtggttatcaagttttagttgaacgagaaattggtgaacgtttaggattgtcggtaaatcatttagcggatttagatgaaataggctgtttagcccatcttgccattgttattggtggtgatggtaacatgttaggacgggcgagagtcctagctaagtataatattccattaataggtattaatcgtggtaacttagggttcttaactgatattgatccgaaaaatgcttatgctcagttagaggcttgtttggaaagaggcgagttttttgttgaggagcgttttttacttgaagcaagtattgagcggaatggagaagttgttgcacaaagcaatgcaataaatgagacagttatttatccggctaaaattgctcatatgatagattttcatgtatatattaatgataaattcgcattttcgcagcgttcagatgggctgattatttccacaccaacaggttcaactgcgtattctttgtcagcaggaggtccaattttaactccgcagcttaatgctattgccttggtgtcaatgtttccacatacgttatcttctagacctttggttattgatgctgacagtaagatttcggtgcgttttgctgaatataatacatctcaattggaagttggatgtgatagtcaagtagcgctttcttttacccctgatgacattgtacatgtcacaaaaagccaagataaattacgcttgttacatctaaaaaattacaattattacaatgtattaagtacaaaattaggttggcttaaaaatttagcttaaaaaatttttataagtctatttactgtatataaaaacatatatataattgtatttatatacagtaaaggattcatgctatgttagttcaacttaccattaataactttgcgattgttcatcatcttgatattgaatttgcgaaaggtatgtcagttattaccggcgaaactggagccggaaaatctattgctattgatgcactcggactttgtttagggcaaagaacagagttatctatgttacgtgacggacaagagagagtggatgtttgtgccacatttcatattgagagcattaatcctgcttatcaatggctacaagagcaggagttacaagattctgacaaccctgaatattgcattttacgtcgaattattaattctgatggacggtcgaaggcttttattaatggcgttgcagtatcagcctcacaactcaaagctattggacaatatctgattcagattaatggtcaacatgcttctcaacaattgctaaaaagtgactaccagattcatattattgatcaattttgtggacatgaggacttattgaaaaatatgcaagaaagttaccgcacttggcgagagttacaggaaaaagtaacgacatttcatcagaaatgtgctgaaaatgaagcaaaaaaacagctattagaatatcaagtagaagagttagatcagtttaatttgaaagaaaatgagtatttggagttggaagaagagcatactcgcttatcaaatagtgaagaattgatgtctttatctcagtcaacattacagttattaagtgaaaatgagagtgtgagtattgatagcctgctttataaagcaacacaatatattgatgagctttgtcaattggattctaattattctgatgtgcaaacaatgttgcaagaggcacttattcaaattcaggaagccacgtctgaaatgcaacatttatcctcaaatattgatcaggatccaaaactgttacaggctgttgaacagcgtatgggacaagtgttacaactcgctcgtaagcataatgtgaaaccacaggatttagttgaattacataaacaactgaaaaatgaacttgagcaactcgttcacttttctgaaagtgaatcgcaattgatacaacaagaagaacagatgcgacaacatgtgcaagaaattgcaacgaaacttagcttaagtcgtcagcaaggggcaataaaattatcaacacaagtgacacaatctattaaattacttgctatggaaaatgcggagttctcaattacttttgatgaggataaaaaactcacaagtaaaggttatgatcaactctgctttaatttgagagcaaatctaggtcaatcagtacaacctttaaataaggttgcttccggaggggagctttcacgtattgcattggctatacaggttttaacctctgataaagcagctgttcctactttaatttttgacgaaattgatgtgggaattagtggtgctacagccagtgttgtgggcaaattattgcgacaattgggcgaaaaatgccaagtcatttgtgtaacgcatttacctcaagtagcttgctgtggacataatcattttgctgtagaaaaacaggttatagaaaataaaacaataactaaaatgaccgcacttacatcagaacagagagttattgcattagcaaaacttttggggggacaaggcattggtgaaatggcattagctaacgcacaagaaatgttggatttagtcaatataaattaaatttcatttcgtgtatttcaccaaaacggattatattgtatccgattttagatctgatctattaataacagactctagcctcagtacataaaaatgcttatgaagtaaatagctgatactgtttcacttatattaattctattgtctgaggtagagaaaaccatacagcacggacttcacatcgatgtttttaagtctgattttttaaccctatataacctcgtttttgcaaagttgcttctttggattttctgatcattgtttctattgtcgtgccttgaattaaaattgaaaagagaacaacgctgtaagtaataataataaataaatctcgcacattcataccgatattttctaaaaatgcacttgttgcaggaatagaaagtgccatggcaagagagagaccgcctcgtaagcctccccaagttaaaattcgtaaagtataaggattgtacacagttttcatacttaagaatttgaatgggatccatacgcttgcataacgacaaaataaacataccggaatagcgattagacttaagatgatcgcttgtgaagtaaagttcaccaataacatcgcagagccaattaataagaataaaagtgaatttaagaaatgatcaatcatttcccaaaagtgatcaagatagtgttgactttgttctgaaaaaccggagtgtcttgtccagttggaaatcataattccggctacaaccattgccaaggcaccagaaacatgaagcaaatttgctaacataaagccagcagtaggaatggttaaagtgagtaagatttctaaacttccgtcatcggtagctgaaatcagaaaatgagcaataacacctaagattaagccaaagaaaattccaccaacagcttcagctaagaagagttttgtaatctccattgcagttggctcatgtccaccaaatgcaacggtaaaaatagttgtaaaaataactaatcctacaccatcattaaataaagattcaccctctactttcatggataatttttttggtgcttttaagtttttaatgatggccaatacagcgatagggtctgtcggcgaaatgagagcgccaaataaaatacaataaataaaatctatatgcagccttaataaggcagatattccgtaaaataaaactccaataaagagagttgatgctatcgttgaaaacaaagctaatattgtgatctccaatttttggctttttaatacaggtaatttaattcccaatgcaccagcaaaaagtaaaaatcccaagatgccatttaataggaaatctttaaaatcaatgcgttgcataacgttttgagcaatgtcgtctaaatggaataaattagtggatcctgcgattagtaatatcagtgaacctacagttgctgttgcggtgattgcaattgtgtattgaatacggtcactgattttttgagtgacaaaaccgattaaaatcgatatggtagagagaaaacaaatgtaagtataaatactcataagaagtaccttctaaaatttaaaaatctgtttatattttattaattaatcaaattagtaaaatataaacagacttgacttgttctaattgagatagtcaagtagcgattgagcattagaaagttaataaaatgtaacaagaaaaatttttgcctagtataagtaaagtcctactttttataaagttcatttttataaaataattagaaatagttaatttatagcgttattttcgaccgcacttttgatatgaaaatgcttgtttaaggatagtaatggcagaataaattttgtttgttctgccattatatgttgaagaatgaaaaattaatattttgccacaataacaatttccactttccatttcgggtcagccaattgactttgcactgtggctctggtcggtgcattatgagaatcaacccattcatcccatgccttattcatttcttgatagtcttgcatatcagctaaaaaaatttgtgcattgagtatgttgcttttatttgaaccgatttctagtaataatttatcaattagacctaatacttcttttgtttgtaaataggcatctacatcagtattttccggtacttgtccggcaaaataagcagtattattgtgaattgttatttcagatagccgtccgttagaatgaaagcgttgtattttttccataatgtctccttagtgaataatgaaattatgtataaagattatagcgatttttgtaaaaatggactaggatctgcaagtttttcttgaattattgtagtggaaaattttgtgtgaaaatgctgatttctaaccaacatggtgcaactttaatggcattaatgccatttttatatggtatgcttttggctaaaccgacttggcagcattcctttttatttttggcttggtttagtctatatttaatgagctatcctttttttcatttgttcaaaggtaaaaaatcgaattttataagatatcaaaaatatacattgatttatggcacgacaagtttgatatttgcactacctgttttttactacaattggcacattttatattttcttatcgcaatgttaccttttggcttcatcaatatttattttgtaaaacaaaaaaatgagcgagcattaattaatgatttggcggggataattatctttgctattgccggtatggcaagctattatttttctacttttacctttactcaacaaatttggttagttgctttattgccaagtttgtatttcatcggcactactttgtatgtcaaatcttgtttgcgtgaacgaaaaaatcctaagtatttattggcttcttacttgtggcattttgcttgtgttgttctttttgttgcaatacaacagttttatcttgcatttgcttttgttataccggcaatacgtgcctattttttaccgaagatgaagatctcggctaaacaactcggtttaattgagattgcggtagcccttgtattttttattcaacttctttttgccactttatagagaagaggactactatgaaattactaatgttatgtcgagaacctcgcctttacagttgtcagcgtttaaaagaaagtgcggaagataatgggcatcagatagatattctggatcctaatcgttgcttattaaaactctcgaaaaatgcaccgcactttgaattgtattatcaagtgaatagtaaaagcgaaccgtatttattaccggattatgatgcgattattcctcgttttggttctacaagcacaagaatggggtgtgccgtgttacgacattttcgtacaaaaaatgtattttgtttaaatgatgatgttgcgtttttaaaagctagagataaatggcttagtttacagttattgactgaacaaggtattgctgtccctaattcagcattgtcaggtgcagaattttctgccactcaagccattttgcaaattcaatcgccgacgattttgaaaacgttacacggatcacaaggaataggcgttattttggcagaaaatcgtaaaagtgcggtgagtattatggaaactttaactcaagcagacgtaccgttattaatgcaggattttattcaggaagcacaaggaacggatattcgttgttttgttattggtgataaagttgttgctacaatgcaacgtattggacaagaagatgaatttcgtgccaattttcatcgagggggaagtgcagagaaaattcagttaaccgaacaagaaaaagtactggctttaaaagcaacgaaatgtttagggctagatgttgcaggtgtcgatttgatccgttctaaacaagggttgttagtgctagaagtcaatgccagtcccggattggaaatgatcgaaaaaaccagtggaattgatattgccttgcaaatgatagttcacattgaaaagcagtttaagagataatgttttactcgtagtgcggtagaaaaataccttgttttttgttttaataatgaaatttaaaaaatcccgatatttacaaaggattcacaccttaacatactgaataaataggttaattatgttcttttggtatcaaaatcacgttatagctaagttacttgtttggctgttattcccattttctttggtcttttggtttatttctgttattcgtcggagattatttcgattaaactggctgaaatcctaccgctctcctgttcctgttttgattgtgggtaacttatctgtgggaggaaatggaaaaacacctgtaacgatttggttggtaaaacaatttcagtcgagaggtattaaagttggcgttatttcacgtggatacggtagccgagcagagtattatccatatttagttaaaattgatgataatccaactatttccggtgatgaacctttgttaatcgcacaacgtacaggcgtacctgtttgtatttccccgaatagacaacaagcaattgagcttttactggcacagtttaattgtgatttaatcattagcgatgatgggttacaacattataaattacaacgtgattttgaaattgtagtgattgatggcgaaagggtatttggcaatggttttgttatgccggcaggacctttaagagaattaccaaatcgtttagcggaagtggatttaattattaataatggaaaactaacaggttatagtaatacgttaatgatcttattacctaaattcgccgttaatttagtcagtggtgagaaaaaactattacgtgattttcaacgtattcctctcaatgcaatagcaggtattggttatccgcaacgtttttttaatatgttacgagattttgcgttaactcttgaaaaaacgcaaagttttcaagaccatcaggattttgaagcaacacatttcgcatatttctcttcaaatcaaccgctctttatgacggaaaaagatgcggttaaatgtcgtccttttgcacaggcgaattggtggtatgtgccggttgaggctgatattcagggagaagaggtagaacgatttatgcaagttgtttcacaacaaataaaggagaaaaaatgaacggaagattattagaaattgtcgcatgtccaatttgccaagggcgattgaaatacgacagtgaaaatgagcaacttatttgtcactttgatcatattgcttaccctattaaacaaggtattccaattttactttccgatcaggccataagtttgtctacatctttaaccaatcctgagcaacaaaatcagtaataaggagaatattcatgaatttcacggttattattcccgcacgttatgcgtccagtcgcttaccgggtaaacctttggctgacattgctggaaaaccaatgatccaacacgtttgggaaaaagcacaacaatccggtgcaacaagagtggtcgttgcaacagattatgaggaagttgcacgagcagttcgtggttttgatggagaagtttgtataacttcctctcagcataattcaggtacagaacgtttggcggaagtgatagaaaaattagctatacctgatgatgaaattattgtgaatattcaaggtgatgagcctcttgttccccctgttattgtgagtcaagttgcacaaaatctacaaaaatatcaagtgaatatggcaactcttgcagtaaaaattgaatatgtggaagagttatttaatccaaatgtagtgaaagttttaacagataaagatggttatgttttatatttttctcgtgcagttattccatgggatcgggatcagtttgttcaactgggtaaagcagatttatctcaattgcaattgcaccaacattatttccgtcatattggtatttatgcttatcgtgccggctttattaaacaatatgtacaatggcaacccacaacattggaacaaattgaaagacttgaacaattgcgtgtcctttggaacggtgaaagaattcatgtagaattagcaaaacaagcgcctgccgttggggtagatacggtagaagatttagaaaaagtgcggtctattttatctcatgtttgatgccaaaaactttcttgccaatgtaacgcaccagcccggtgtataccgaatgtttgatgaaaaagggcaggtgatttatgttggtaaggcaaaagatttgaaaaagcgtttatccagctattttcgcactaatttgaacagtaaaaaaacttccgcactggtttcgcatattcattcaatagaaacaacaatcaccgcttcagaaactgaagcattattgcttgaacataattatattaaagcttttcagccccgttacaatgttttattacgtgatgataaatcctatccctatattctattaacgaaagaacgtcatcctagaattacctcgcatcgaggttcaaaaaaagtacaaggtgagtattttggcccttatccccatgcaggatcggtacgtgaaactctctctttgttgcaaaaattatttcctattcggcaatgtgaaaactcggtatataacaaccgctctcgcccttgtttgcagtatcaaatcgggcgttgcagtggcccttgtattgatggtttagtatctgatgaagaatatcagcaacaggtcgattttgctcggctatttttacaaggtaaagatcagcaagtgttggagcatttgatcaaaaaaatggaacaagcgagtatgcaacttaattttgagcaggcagcttatttccgtgatcaaattcaggcgattcgtgcggtaattgaaaaacaatttgtttctaacgaacgtttagatgatatggatattatggcaattgcttatcagcttggtattgcttgtgtacaagttttatttattcgtcagggaaaagtattaggtaatcgcagttattttcccaaagtgccggcaaatacggatttaagtgaattaaccgaaacgtttgtcggacagttttatttacaggggcatcaaggtcggattataccaagtaccattattgttgatcatgttttgaatgaaaaacatgaacttgaggttttattaacagaacaagccggacgtaaagtaaatattcaagataatgtgaaaggcaataaaagcaaatttttacatctggctcaaatgaatgcacaagccgcattagtaacacagcttaaacaagctaatttaatacaagagcgttatcaggcattacaagaacttttgtctttaactaccattaaacgtatggaatgttttgatatcagtcatactatgggagagcaaacaatagcttcttgcgttgtttttgatactgaaggaccgttgaaatcagattatcgtcgtttcaacataagcggaattactgcaggcgatgattatgccgctatggagcaggctttgttgaaacgttatgatcgcccattagaaaatgagaaaattccagatattatttttattgatgggggaaaggggcaattaaaccgtgctttacaagtttttgcacaattaaatgtctcttgggataaaaataaaccgctcttaattggggtagcaaaaggggtagatcgtaaagcaggtttagagacgttaattattagtaaacaaaataaggaagtgaatttactgcctgacagccttgcccttcatcttattcaacatattcgtgatgaaagtcatcatcatgccattggcggtcatcgtaaaaaacgtcaacaggcttttactcaaagcggtctagaagccattgaaggtgttggagcaaaacgaagacaagctttattaaaatatttagggggcatgcaaggtgtaaaaaatgcgactttagcagaaatttcctccgttccgggcatttctgctgcgttggcggaacggatttatgaaacgctaagaagtgaataagcagtaacaaagcaaaaggggaaaatatttaatttccccttgttttatctataaaatcagcaaaatcaaagaatgatgtttccattatcatctgccggttttgttagcccgataataaattcaatgagtgcgataaaaccgggaatgaaagtccaacagaataaaagatataaaatacctaatcccgttttaccggcataaaatttatgaatacccaatccacccaagaaaaatgccagtaagcaataagcaattttattcaccgctttggctgtttgagcataggtattttttgtttttaaaataacaggtgcttcatcagtaccgaatacatcgacttcatctctgacatgtggctcaaaatcaagagctgttctgtgtactactttgattgaaccatcaggcataccaatagacaccatattatcttcaatttttataattttagccataacattccctcttagtgttattagttttaattaattaaaatttttaaaagccaaggaagaaaaagctgaataagagaattttttcattggcttaaaagtgcggtttattgtactcaacctagaattagttagcaatatttccaataatgcttctcgtttcttctttaacgtccacaagttgaacatgaattatatcgccaattttgtatgttttttctcctttaatataaagtgcgatttcctcagaatttacctgaagttcttctctattgctatgtaaggttgatgccggaataaagacggaagcaccattttccaatagaagtacacgtaatccgccacgcatgacatcttgtatttctgcttgaaatatttgtttttgttctactttatctgctaaatagcgacaatataaccaatctgcaatatctcgctcaactaaacggttttgacgacgagcctcttgtaaacgttgtaagacactatcttgagggcgttcatattgttgtgttgtgagactcgctttaattaggcgatgattaactatatccgaatatttacgaattggagatgtccatgtggcgtaaccttgcaaacctaagccaaagtgcggtgctaattccgttttaaattctgctgaggttaagaaacgacgtaaacgcaattcaagataattattctcgcttgctccaatatcatgacgcatattgcagtatccacttaaggttgctaaattttctacagaatagcgttgtttcaattctgcttgattttgttcgttggttaaatttgacagcaggaaatgatgtgcattttccaagaattttttatcgaaaccactatgagtattaaaaatcccaaaaccaattttttcatccagatattgtgccgcacaaatattcgcaataatcattgcttcttcaacaatttggtttgcaatgcgacgatattctgttttaatctcttgtactttaccattttctgccagtacaaaagagtagtccggtttttctgtaaacagtaaagcatgagttttacgccattgtgatctggctaaggtaaactcatgtaaccacgcaatttgttgttgagtaacaggatcttgtggttgccaacagcctgttttttgttctaaataatcagacactttatcataagctagtttagctttcgacattacataagcagagacaaagtgcggtggtgcggtaatttcaccttgtaaatctgttgtgatataacaaaccaatgcggcacgttgagcattttcggaaagagagcaaagatcgtcggataactctcgaggcaacattggaatattaaatcccggcaagtaattagtgaaacaacgttgtctggcatcttgttcaatttgtgaattaacatcaatataagctgttggatcggcaatcgcaacgactaatttccaaccgacttgagcttcattttcgctaattggctcaatatataaagcatcatctatatcttttgttgtttcactatcaatagtgatgaagtgaagtgcggtgagatcttcacgttcttgttgatccaatagagggtaactttcttgtccctgtacaggataacgagattgttcatgatgtgccaaagttacccaccaaggtgcaagttcgtcaccagcgtgacaaataaattcagaaatgtgtgcaaagaaaaaacgatcatcacgtaaaggatggttttttagctgtgccacaacccaatctccatcttgtaattcttctttaacggcttttgtttgtgtcgctccaattggctgattaatttgggggtgattgactacaagttgtaatttcttgtctttattgaaccgcactttggcaataaagcgagttagcatgggttcaatgagttcttccggttcagcctgttctttatcgccaatcgtttcaatcactgctttaattttgtcgccatgcataacttttttcattgccattggcggaataaaataactttttttatcacactcaaggaaaccgaaggctttgtcagaacttcttacaataccttctacatgcggtttactatcacgaatttgttgtttgagttgggaaagtaggggattattttgaaacatattcttacgctataaatgaaaacggatgttcagttgaacatccctagaaaagattaaatgtagattattctgcacctaagtcgcccatggcagtaatgctaaaaccggcatcaacatgcaatacttcacctgttatacctgaagccaattctgagcataagaatgcggctgaattgcctacatcttcaatagttacggtacgacgtagaggggctgtgttttcaaaagtggccagcattttcttgaagtttttaatgcctgatgccgctaaagtgcggattggaccggctgaaatagcattgacacgaataccgtctttacctaagtctgccgccataacacgagttgccgcttcaagagaggctttcgctaaacacatcacattatagtttggaatggcacgttcagcacctaaataagtcaacgttaataagccggcgttttgatttaacattggacgggctgcttgtgccattgcaacgaaactgtatgcactaatatcatgtgcaatgcgatagccttcacgagttgccgcattgacatagtcgccgtcaagctgatcacccggagcaaaagcaatagcatgcacaaaaccatcaaacttgtcccaatgctgttttaattgtgaaaaacatgccttgatgctttcatctgttgcaacatccaaaggtaaaacaatagtagaaccaaattcttgtgcaaattcttctacacgtgcttttaatttatcgtttaaataagtgaacgctaattcagctccttcacgtttcattgccgttgcaataccataagcaatagaacggttgctcgccaaaccagtgattaaaatgcgtttacctgctaaaaatcccataataaaaccctttattcggttagttaaaaagtcggcatagtataagtcaaaatgagagaaaaaacaaaagacgcaagagtacgctgatctttaagctggattatcaatatctttaaattcaacttcaaaaccgtattcttgagctagccattcgcctaaggccttaataccataacgctccgttgcgtgatgaccggcggcaaaaaaatgaatgccttgttctctggctgaatggatcgtttgttccgatacttcgccggtaataaaagcatctaatccttttgttgcagccaaatcaatataaccttgcccgccgccggtacaaataccgacagttcggattaagtgcggtgcattttcaccacaaaataagggtttacgccctaatgctttttcaatgcgttgagccaactcttcaccgcttaccgtctcaactaaatcaccataaacaggaatactgaaactaccattttctaatgggcgtaaattttcaatacctaataacttcgcaagttgtgtattgttacccaactctgcgtgtgtatctaacggtagatgatatccatacatattgatgtcattttgcaacaaggttttaatgcgtttacctttcatccctcggatgcaaggattttcatttttccagaaatagccatgatgaaccaaaattgcatcagcttgttgtgcaacggcataatcaattaacgcctggcttgcggttacaccggtaataattttttgcacattggattttccttcaatttgtaaaccgttgggtgcataatcggatatattggcactattgagtttttggttgataagttgctccagttcaagattattcatattgttatccatccaattaaattttatttaatttcagttccttttaataacttacgtatccaactgcgatttgggctgagattatgtagaatatcttcgctcaaagggagtggttctgcataaatcagagaggcaagggtttcacctaataaagcggctgaagttaaccctcttgagcctaacgcaccgatgagatataaatttttccattgtgctgcatcaggaataggctgtttacgacgacgtaaattgaagatgtttcggtagtctaaacattgttgctcaaaatgaggtacattccccataatcggcacacgatcacgcactgaacaacgaacacctattctagctatattggctgatatatcaatatcctgcaaccaatccatgtttttatccgtatcggtagaagctagattttgttgaattttttgctgattttccagttgttcttgatagctaaaatggcgatctttgttattgcgaatatgacttgcaccaaggcaatgactctgtttcattttatccgccggagttaaatagccatcgtaacaaagtacggatttaagtttcagtaaattttcactggtcggaatttggctgacttgacctcgtacgggataaagaggaagtttagctgtttgcacaaaatctgtaatttgataaccattggcgagtacaacaacttgatgattaaaggtttcattttgttcattggttaaaacccattgtaaatttcggtagtcaagtgcggtaattttttgtgaggttttgatctctaatccaagttgttgtaagtaagagaaagtattttgcacaaattgacgtggagcaagccaagctccctgcggaataaaacctcctgcacaatctaaaggaagccctattttttcacttaactgctctttatttaaattctgatacaagctttttgaccattgataagaagaaatttttgccaatttaaccgcacttttgtgatcgtaagcacaaagtgctacaccacaaaattcatgttcaaattctataccttgtttaattgcccactgcaattgttgtaaagcatagaaaaaggcatgaacataaaaacgaatgttgcgatcatcgtcatcacttaattgaggataaaaagcaccttgtttgttaccggaggcattgagggcaagttgctcatcttcacaataaagagtgatttttgcccccctttttaatagtgaaagtgcggtgaaaagtgaagcgattccgcctccgataattgcaatgtcttcagaaagtaatgaggcgggctgacttaagtaccaaggggattttgcattttgttgtggaatagcgtttttaataccacataaacattcccgctttttgccgtaaccttttcgtttttgtacttcgaatccggcagaaactaatccttttctgaccgcacttgcagcggtaaatgtggaaaatgttccttgtggcttgctgtaatagaacatctgttgatagagttcatcattccacatttgtggatttttactgggtgagaaaccatctaaaaaccaagcatcaatgcgattttgcatataatcacccagttggggcaaattatcggcaatatcaccaaaccataaatccaatgttgtttcagcaaaatgaaaacgctgacaaccttgtatcgcctctaagcaataatcgcataattgttgtgataaagcagaaaattgtgggtaaaattgatgaatttgttgtagttgaactttgggaagagggtatttctcaaaggaaataaaaaatagatgtttaagtggggaatgagaatattgttgccgaaattggcgaaataaacttgttacggcaagaaaatttaaacctgtaccaaatcctgtttctgcaatgacaaaatgtttttcttgatagacaatccagcgttcccataaatgattaccttgctgaaatacgtattcgctttctgctaaaccgtcttggttggaaaaataaacgtcattaaattgttctgataccggtgttttttcttgattcaggtaaattttggcgggcgtaactgtaaacataatatagctaatttttttgttgcattcatgatttttgctataatagcgaaaattttttcactggtcgaacattcgaagaaagacttgaaatattttcattttatagtaagttggcgaccgattattttattctttaacgtaaaggaatgtttctatgagaagagccgtggttacaggttttggtattatttctagtattggtaataataaacaagaagtgttagaagctttaagaaaagggaaatcaggtattgaagtgatgccggattttgtcaagatgggcatgcgtagtcatatagcgggaacaattaaattaaaccctgctgaattaattgaacgcaaaattttccgttttatgggagatgctgctgcttatgcttatctctcaatgaaagaggccatcgaagatgctggattgacggaagatcaagtttccaatgatcgtaccggacttgtcatcggagcgggaacaggatccggtcataaccaaatggttgcttgtgatgctgtaaggggtccaagaggcgttaaagctattggaccttatgcagtaactaaaacgatggcatctagtgtatcggcttgcttagcaacgccttataaaatccgtggcgtgaattattcgattagttctgcttgtgctacttctgcacattgtattggacatgccgtagaattaattcaattaggtaagcaggatgtggtttttgccggtggagcggaagagttatcttgggaatgtgcaactgaatttgatgcaatgggagcggtttcaactaaatacaatgaaacgcctgagaaagcttcacgtgcttatgacgctcatcgtgacggatttgtgattgccggtggcggtgcggtagtcgttgttgaagaattagaacatgctttagctcgtggagctaaaatttatgcggaaatcgttggctatggtgctacatctgatggatacgatatggttgcaccgagtggtgaaggtgcggagcgttgtatgaagcaagcactggcaacagtatatacgccaattgattatattaacgtgcatggtacttctacacctgtaggtgatgtaaaagagttaggtgccattcgcaacgtatttgctgatcaaaaacctgccatttcttctacgaagtcaatgacggggcattcactaggtgcggcaggtgctcatgaagcgatttatagcttattgatgttagaacatgattttattgcacccagcattaatattgaaactttagatgaacaggcggtcggtatgaatattgtgactgaaacaaaagagaatgcgggactcgaaaccgtgatgtcgaatagttttggttttggtggaaccaatgcctgcttggttttcaagcgttataaaaaatagagataattcttttatagtgatctatctaatgatttagacagatactgttcttttagaccttattttaaagaactattttagatattgaagtgagctgcctctaaaagttggacggaataaccaactgattagaggcagatttttatgattaaatgcaaaacaacaaactactgagtagtctttttatatttttagaatttgttttatattaaaattctctctttatctttaaataaaaatttaataaatatcaagtttaatgaatataatttttaataattgttattttgataaatttaatttaatgatattatcttaatgctttaatatggaaggttaaatcctgaaaagcaaagtactgaatacgatgttgctattaagcgaacttttatacgcatgaaacaggtcgtggcgtcttttgattttttattttattgatgtggttattatgaaaaaatttattttactcggattattactttctttttcttcatcaagcattgctgagttatctgattggattaagccgatttcggatatctcctccggagatactgcatgggtgatgatatctgcaatcttggttttatttatgactatcccaggtttggcattattttatgggggaatggttcgtaaaaagaatgtgctgtcgacaatggcacaaagttttgcggtaagcggtttgatagccgttatttggttgtgtttcggttatagtctttcatttacaccaaataatgcttttattggcggaatggatcgtttttttctgcaaggtttaaatgtgtttactgaacagaaaatgcttactgtttatcctggagctggaacgattccggaatctgtttttatgatttttcaaatgacctttgccattattgccggagcgatcattacaggtgcgactgtagagcgtatgaaattttcggcattattgttatttgttggattatggtcacttttgatttatgttcctaccgcacattgggtatggggaataggtggttggttagtaaatgatggggtattggattatgccggtggtaccgttattcatattaatgcaggtgtagcaggattagtcgctgcaattgtcattggtaaacgggtcggttacagacatgaagtgatgatgccgcacaatttagtattaactcttataggtacggcaatgttgcagattggttggtttgggtttaatgcgggttcggcacttgctgctgatgcaagagcgggtatggcattagcaactactcagatttcagcctcggtcggagcattaacttggatattagtcgaagtattttgtaaacacaagccgtctgcgttgggtttggcatcaggagcggtagcagggttggttggtattacgcccgctgctggttttgtatcggtacaaagtgctttattcataggtatgataacaagtgcggtctgttttgtcggtgtaatgaaactcaaatattggtttcgatacgatgatacgctcgatgcgtttggtattcacggtttaggcgggattgtcggagcggtgttgacaggcatattcgtatctcctgatatttcagccaccgaaaccacactttggacacaaattgagagtgtattaattactatcatttttagtgcctcaggtagttttgttttattaaaaataattgacaaaaccgtagggttacgagtggagcgagatgaagaacgtcaaggtttggatttaagttgccatggtgaaagaatagaatagttaaaaaatgaccgcactttacgctttataaagtgcggtcagattatagtagctatatagtttgaagatgaaattcgaacacctattatttggcgttaattaaataatttttccctccagtatccaaattcttttaacaattgtgagtttatattcaaagaaattgcttgtatttgtacttaaatcgtgaagttagtcgttgatggttgtagaaaaaataaaagttacattctaaaagaagatccaaaatttaaacacgcaatagatagttttgaatggacagcttagccttgtggtaggggcttgccctcgttctctgttttttgctatcaacctattttcaggtaaatacagagaacccttctcgactagtttggatttaccgagtaatcaataagggaatatgcctgaaaaaatggttcatttcttaattgttagcatactattatcaagctgcatgagtactgctataaaattttaggataatttaggataatactgggggaactctctcaaacagaagccaaaatttttgatcaatgccaagagggggtaatcaattaaaaagtaataacagatttaaccattaacttttaatttacggagatatatgataaacagcgtgaacaattcaattttttaacgaactaacccattcgtcaaatgtaatatcactcaaattaagaattttgaaaaagatttttcaatcaaaagccctgaagattatagaaattatttatgctatttaataatagcggagctagtgttcatcatatgtatggattgcataattatgagacatgtagattttgaatggaaaaaggcatattggagtatgaacagggaactttatatcggttattatgatttggagcgggaaacgaggctcgaactcgcgaccccgaccttggcaaggtcgtgctctaccaactgagctattcccgcttattcctgaagaacggagcgtattatacaaatattttactaagaagcaaggttaaaatttaaaaaaacgcaaccttgcttgattattggttgaattaattatttggttgttaagttaataaaggtattcctataatgagctaattcagcaatggattcacgaatatcatctaacgccaaatgtgtgttctttttttcaaagctatttagaatttcaggtttccatcttgatgcgagttcttttagtgtgcttacatctaaatgacgatagtgaaagtattcagctaattcaggcatatagttgactaaaaaacgtttgtcttgagctacactgtttccacaaataggagaaacacctttaggaacccatttttttagaaaatccaaggtttgtaattctgcagcccgttctgttaatttgctgttttttacccgttcgattaagccgttagatgtatgagttttcacgcaccattcattcatgttattgagaagttcgtttgattgatgaatggctaaaacaggaccttcagctaaaatattgagatctttatctgttacaattgttgcgatttcaataatccgttctttatcaggatctaagcctgtcatttccaaatcaatccaaataagattttgtttatctaattgcataataagagtatcctatacaaaatttcttatattctaactgaaaaatgaccgcactttaaggatttctctttgagcaaacgtaaattaacccaaaatcaacaacgtcgaattcaatctaataatgcaaaaacattacatcgtaatcaacatcggcacaaatcagatattgattggcaagatgatatgcttggtgattttcaagatggaacggttgtgacaagatatgctgttcatgctgatgtagaaaatgaacaaggtgaaattgttcgttgtaatttacgccgtacattgaaaagtgtcgttgtgggcgatcgtgttgtttggcgtaaaggaaagacacaactacaaggtgtaagaggggtcattgaagcggttcaaccacgacataatcagattgtacgcccagattattatgatggcttaaaatcgattgcggctaatattgatcgaattattattgtttccgccgtattaccaaatttatctctcaatattattgatcgttatttagttgtttgtgaaagttcgaatattcctgccgttattgttgtaaataaagcagatttattgagtagtgaagctcgaacagaagttagcttacaactcgaaatttatcagaaaataggttatgaaacgttattaatctctgccaagagcggtgaaaatatggataagctaaccgcacttttgtctgagggaacgtctatttttgttgggcaatcaggtgtgggtaaatcaagtttaattaattatattttgcctgaagtgaatgcacaaactggtaagctcagtcaagtatctggtctaggtcagcataccacaacatcttctcgtctatatcacttatcacaaggaggaaatttgatagattctcccggtattagagagtttggtttgtggcatttagagcgagatcaaatcacgaacggttaccgagaatttcagtattttttgggaacttgtaagtttcgagactgtaaacatttgcatgatccggggtgtgctattcagcttgcagtgaaagaaggaaaaatcgatcctttacgttttgaaaattatcatagactaattacaagtttgtccgaaactaaatctcaacggcattttatatcggcgaattaagttaaagaagatattttgtatacttaataaacaacttggagctttttttgtgatgtagttcaaattttaatgtggtttaccttgattattctgatttgaaacttgatactatgcgtccgatttatttttttatttaaaataaatatgaactgacactaacgaattgtttttgaagcgttaggatactacatgtagaatgatttaaattaagaggatacagttatgtactcaaaagatgttgaaattactgcaccaaatggtttacacactcgtccagctgcacagtttgtaaaagaagccaaagcgttcgtttctgatattacagtaacttcagcgggcaaaagtgctagtgcaaagagtctatttaagttacaaaccttgggattgactcaaggtacagttattacgatttctgctgatggtgaagatgaacaaaaagcggttgaacacttagttgcattaattcctactctagaataatcaatatatttattagccataacttaatgttttcataaataataagtttatggctattgtgttatttagcgtattgtaatttaaaattattttggaaggttaatatgatttcaggtattacagcatcaccaggtattgtatttggtaaggcactggtgcttaaagaagaaaagattgttcttgatacgcaaaaaataaaagatgagcaaatagacattgaagttgctcgtttttatagcgggcgtacggcagctatagagcaattgattgcgattaaagattgtgctttagtctctttaggtgaggaaaaagctgcaatttttgaaggacatttaatgatccttgaagatgaagaactggaagaagaaattttagattacttacgttcaaataaggtcaatgcaggcgttgctgcaagtaagattattgatcaacaagttgctatgttgtctgaaattgacgatgaatacctacaagagcgtgccggagacattcgtgatattggtaatcgtttgattaaaaatattttaggtatgaaaatcgttgatttaggggatattaatgaagaggctattttggttgcttatgatttaaccccttctgaaacagcacaattaaatttggataaagtattaggcttcattacagacattggtgggcgaacatcacatacttctattatggctcgttctcttgaattgccggctattgtaggaaccaatgatatcacttcaaaagtcaataccggtgattatctcgttcttgatgcggttaataatgcgatttatgttaatccgacacaagaagaaattgagcgtttgaaagctttagaacgacaattagccgaagaaaaagcggaattagctaaattgaaagatttgccagcattgactttagacggacatcaagtagatgtggtagctaatattggcactattcgtgattgtgagggggctgatcgtaatggtgctgaaggcgtcggattatatcggacagaattcttatttatggatcgtgatcagttaccaacagaagaagaacaatttattgcttataaagaagttgttgaagcaatgaatggtcgtttagttgtgttacgtacaatggatattggtggagataaagatttaccgtatttgaatttacctaaagaaatgaatcctttcttagggtggcgtgcgattcgaattggtatggatcgtcgtgaaattttacatgctcaattacgtgcagtattgcgtgcgtcagcttttggtaaattagctgttatgttcccgatgattatttctgttgaagaaattcgagaattgaaatctgtgattgaaagtttgaaacaagaattacgtgatgagggtaaggcttttgatgagaatcttcaagttggggtaatggttgaaacaccggcggcagcaataaatgcaaaatttttagcaaaagaagtcgatttttttagtatcgggacgaatgatttaacccaatatactttagcggttgatcgtgggaatgaattaatttcacatttatacaatccgatgacaccggctgtattaaacttaattaagcatgtgatagatgcatctcatgaggaaggtaaatggactggaatgtgcggtgagttagcaggcgatgaaaatgccacattgttattgttaggtatgggattagatgaatttagtatgagtgcaatttcgatacctcgtattaaaaaattgattcgcaatgtgaattatcaggatgctaaattacttgctgagcaagcattacagcaaccaactgcggcaggtattttgagcttagttaatgattttttagtggaaaaagcacttaattaatatcatttgataaaaaattacgctagaatagtgcaattattcatgagtaggagaaagtttaaatggctttttttgataaattatttggttcaaaggaaagcaaatctattgatgttgaaatttatgcacctatatcaggtacaattgtaaatattgaggatgtaccggatgtggttttctctgagaaaatagtaggtgatggcatagcaattcgtcctacggggaataagattgttgcacctgtagatggagtaatcggtagaatatttgaaactaaccatgcattttcaatagagtccaaagatggcgttgagttatttgttcactttggtattgatacagtagaattgaaaggtgaaggttttactcgtattgttcaggaaggtcaacaagtaaaacgtggtgaaacaattattgaatttgatttggcttcgttggaagcaaaggcaaaatcagtattaactccgctggtaatttcaaatatggatgaaattaatagtatggataaaatgtctggcgaggtcgtggctggcgagtcagttgtactcttgttgaaaaaataatgaatagtgttatttaaaacggattggtagtggctaatccgtttttttatatcaataaatttttaaggaagaacagcatgtgttttttctattttcatataaaaactactatctttatttcaaaaaatctaataacatttacgaaatttgttaagatttgtggcgtaaactagatttgattagtttcgttgtgagttttgctaacattatcagaattttagttatcaatccgttgtttaatttagtgttataaattaaacgtaccttttaacttaacacaataaggaaaagactatgtcagatatattgaaaaatgacgtagatccggtcgaaaccaatgattggttattagcgatcgattcagtaattcgtgaagaaggtattgagcgtgctcaatatattatagaacaattgatgcaacatgcccgtgcaaattctgtgtcattaccaacgggtgtaagcacagattacattaacacaattcctccatcagaagagcctaattaccctggtaatttagacttggagcgtcgtattcgtagtgcaattcgttggaattcgataatgatggtattgcgtgcttcgaaaaaagatttggatttaggtggacatatgtcttctttccaatcttcagcaactatttatgaagtttgttttaaccatttctttaaagctcgtacagaaaaaaatggtggtgatttagtttttttccaaggtcatatttctccgggaatttatgcccgtgcattcttagaaggtcgtgtaacagaagagcaattagataatttccgtcaagaagttgaaggcaaagggttaccttcttatccacaccctaaattaatgcctgaattctggcaatttccaactgtatcaatgggacttggaccattgaatgcaatctatcaggcacgtttcttaaaatatttacataatcgtggcttgaaagacacttcagagcaaactgtttatgcgtttttgggcgatggtgagatggatgaagtagaatctcgtggtgcaattgcgtttgctgctcgtgagaaattagataacttagtttttgttatcaactgtaacttacaacgtttagacggtccggtaaccggtaacggtaaaatcattcaagaacttgaagctcaattcaatggttctggttgggaagttattaaagttatttggggacgccgttgggatcgtttattacaacgtgatacatcaggtaaattattacaattaatgatggaagttgttgatggcgattatcaaactttcaaatctaaagatggtgcttatgttcgtaaacacttctttggtcgttatcctgaaacagaagcattagttgcggaaatgacagacgatgaaatttttgcacttaatcgtggtggacatgatccattaaaagtatttgcagcatttaataaagcaaaacaagttaaagataaaccggttgtattgttggttaaaacaatcaaaggttatggcatgggagaagcagccgaaggtcgtaatatagctcatcaagtgaaaaaaatggatatgtcaggcgttaagcatgtacgagatcgtttcaatgttccggtatctgatgcagaaattgataacttaccttatgttaaatttgcagaaggaacagaagaatataaatatcttcatgaacgtcgtcaagcattgaacggttatttaccgactcgtttacctcgctttacacaacaaatggatgttcctgcattagaagaatttgcacaattatttgaagaacaaagtcgtcctatttccactacaatggcatttgttcgttcattgaatgtattactgaaaaataaatctgtaggtaaacatattgttccgattattgccgatgaagcccgcacttttggtatggaaggtttgttccgtcaaatcggtatttataacccgcatggacaaaattatactccgcaagatcgtgaacaggtatcttactatcgtgaagcaattgatggacaagtattgcaagaaggtatcaatgaacaaggtgcaacagcatcttggttggctgcagcaacgtcatattcaacaaatgatatgccaatgattccattctttgtgtattattctatttttggtttccaacgtgtaggtgatttaatgtggttagcaggcgatcaacgtgctcgtgggttcatgattggtggtacttcgggacgtacaaccttaaatggtgagggattacaacatgaagatggtcatagccatattcaatcttctattgttccaaattgtatttcttatgatcctgcttttgcttacgaagtcgctgtcattatacaagatggtgtgcgtcgtatgtatgggcctgaacaagaagatgtgtattactatatcaccacactgaatgaaacttatgatcaacctgcaatgcctaaaggtgcagaagaaggtattcgtaaaggtatctataaatttgaaacagtaactggtcaaggcaaaggtaaggttcagttattaggttcagggtcaattttacgtcatgttcgtgaagcggctaaattacttgctgacgatttcggcgttacatctgatgtgtacagtgttacttcatttactgagcttgctcgtgatggtgcgaatgcggatcgttggaacttattacatccaaaagaagaagctaaagtaccttatattgctcaagtaatgaatgacgctccggcaattgcttcaacagattatgttaaactatttgcagaacaggttcgtccatatatacctgcacaaagttatcgtgtattaggtactgatggttttggtcgttcagatagtcgtgaaaatttacgtaaacatttcgaagtaaatgcacattatgttgttattgctgcgttaaccgagttggcacagcaaggtactatcagcaaagatgtagttgctcaagcaattagtaaatatggtattgatgcagataaaatcaatcctttatatgcataatcaatatttgaactgagcggatataatccgctcataaaaaaaggataagataaaatggctaaagaaattcaaattccagatattggtggagatgaagttactgttactgaagttatggttaaagctggagatactattatagttgatcaatctgtgattaacgttgaaggcgataaggcatcaatggaagttccatcaccggaagcgggtgtcattaaggaagtattagtaaaagtaggcgacaaagtttctactggaactcctatgtttgtattagagaatgcagaattagcatctaccgagacagcatctgaaagtatgcaaaccgaaaaaacacaaagtgcggtagcgtctatcattgaaatttatgtacctgacattggtggtgatgaagtcaatgtaactgatattatggtttctgtaggtgagacagttgcagaagagcagtctattttaaatgttgagggtgataaagcctcaatggaagtgcctgcccctactgctggtatagtaaaagaaattttaatcaaagtgggagataaagtttcgaccggttctcttgtgatgaaatttgaagttgcaggtgttgtatctgcagccgaaacagctcaagtttcttcttcagctcaagtaacaggtgaaagtgcggtgcaagatgtacacgttcctgatatcggtggtgatgaagtcaatgtgacagaaattatggttgcagtgggcgatagtgttacagaggaacaatctttaattactgttgaaggtgataaagcttcaatggaagtgcctgctccttttgctggtgtagtgaaagaaattttggtgaaatcaggggataaagtttcaactggttcattaattatgcgttttgaagtgcaaggaaaagcccctactccagaagcatcatcggcggtgacagaggctaaagtggctccatctccagctgcacaagaaaatcaaatgacgccagtgtctcaagctgatgtgactgcaagtgcggtgtttgctcatgcaactccggttgttcgtcgtctagctagagagttcggcgtgaacttagacaaggtaaaaggaacgggtcgtaaaggtcgcatcttaaaagaagatgttcaggcttatgtaaaagcggcaattaaagcggttgaaagtggcaatgtttctcctacatcagcaggtaatggtgctgtcaatggagcaggactaggcttgttaccttggccgaaagtcgacttcagtaaatttggtgatattgagcaagttgagttgggtcgtattcagaaaatctccggtgcaaatttacatcgtaactgggtaatgattcctcatgttacgcaatgggataaagcagacattacggaactggaaaaattccgcaaagaacaaaatgtgttggcggaaaaacaaaaacttgatgtaaaaattacgccattagtatttattatgaaggccgttgctaaagcgttagaaaattacccacgctttaatagttcattatcagaagatgctcaaagcctgattctgaaaaaatacattaatattggagtggcggttgatacacctaacggtttggttgtacctgtgtttaaagatgtgaataaaaaaggcattattgaattatctcgtgaattagcggaaatttctaagaaggctcgagctggtaaattaaccgcatcggatatgcaaggtggttgttttactatttcaagtctaggaggaattggcggtacacactttacgccaattgtcaatgctccggaagtcgcaattttgggcgtatctaaatctgaaatgacaccggtatggaatggcaaagattttactcctcgcttaatgcttccgttatctttgtcttatgatcatcgtgtaattgacggtgctgatggagcaagatttattactttcattaatagtgtattaagcgatcttcgtcgtttagttatgtaaatactacgcctctaaatcttattagggggcgttaaaactgttaaagtgcggttgaaaaccgccaacttttaacgaggtaaaaaatgaataaagagattaaaacacaagttgtcgtcttgggagcaggtccggctggttactcagcggctttccgttgtgcagatttaggcttagaaactgttattgtagagcgattttcgacgcttggtggagtatgtttaaatgtaggctgtattccgtccaaagcgttattgcatgtagctaaagtgattgaagaagctaagtccttatccgctcatggtattgtttttggtgaaccaacaacggatattgataaaattcgtggttggaaagaaaaagtaattaatcaattgactagcggtttagccggtatggctaaacagcgtaaagtacaggtagttaatggttatggtaaattctcaggaccaaatgcaattattgtggctggtgatgaaggtgaaacgaaaattacttttgataatgcaattattgctgccggctctcgccctattcagttaccatttattccacatgaagatcctcgtatttgggattctactgatgcgttaaagttaaaagaagtacctgaaaatctcttaattatggggggcggtatcatcggtcttgaaatgggaacggtttatcatgctttaggttctaaaattgatgtggttgaaatgtttgatcaagttatccctgcagcggataaagatatggttcaaatttatactaaacgcattgaaaaaaaattcaatttgttactggaaactaaagtaactgccgttgaagcaaaagaagatggtatctatgtatcaatggagggcaaggcagcaagtgaaactcgtcgttatgatgcagtattagttgcaattggtcgtgtaccaaatggtaaattaattgatgcaggtattgctggcgtcgaagttgatgatcgtggctttattcgcactgataaacaaatgcgtactaatgtacctcatatttttgctattggtgatgttgttggtcagccgatgctagcacataaaggcgtacatgaaggtcatgtagctgcagaagtaattgcaggacaaaaacattattttgatccgaaagttattccatctattgcttataccgaaccggaagtagcttgggtggggaaaactgaaaaagaatgtaaagctgaagggattaattacgaagttgctaagttcccttgggcagcgtctggacgtgcaattgcatccgactgtgctgatggtatgacgaaattgattttcgataaagatacacatcgtgttattgggggagcaattgtcggtactaacggtggtgaattgctaggtgaaattggcttggcaattgaaatggggtgtgatgctgaagatttagcactaacaatccatgctcatccaactttacatgaatctgttgggctagccgctgaagtttttgaaggctctatcacagatttacctaacccaaaagcgaagaagaaaaaataataatctagctcgctgagacaataaggcgatcttttatgagatcgccttatttttttgcaaaaaaatgcggtaaaaaatacggcactttttaggcggcaaattttatttgattttcttttggttttatttgatggattgtattggttactgtaccaataataggcaaagtttgccaattagatgttcttattgaatgtactttattatctagtgggaaaaaaataaattcattattttcatgcatcatgaattcataaatttgaaattggttattaagatctaaaacgacaagatcattcattgaaaggtaattttgtttttctacaataagaatatcaccttgctcaatattccaagcgagcagattaggattgttaacttgaataaaacaagtttgttgtgggtgtttaatacagtaaagattgagatctagttttttgtgtgaacttctattacgttcctcaatatcaatgaagaatggcataggttggtaagaaagtgtagtgtttatattgctgatattctgatttgcgtaacccatctttttctccaatctaagtatgttatatattaactgattatttatacagttatatattactgtttttatatacatatagtcaatagcataatagaaatttttagaaatttgcagattaataaatgtattttattttataaaaattcaaaaaatgtttattttaatattttctttataatcaatttacgttatctttactaaaccttggtggatctatagatctgtatttttaactcaaaaaacacaacatttattattatgaataagtcatatttatactcgttcttttttcatggaagtttggtcaagcgaatttctgttggtcttttattgggattgctgttagcattaatcgctccatcattgcaaggtgtattaggttttaatcttgcagaaaaagccggttttttaggaaaaatatttgtgcgttcattgcgtgcagttgccccaattttagtttttttattggttatttctgcaattgctaataagcaattaggcacaaaaagcaatatgaaatctattgttgtcttatatttgctaggaactttcttagctgcattgacatcagtattatttagttttgcattgccgacagaaattgctttaaaaacgcaagaaggctctctttctccgccaaacgaagtatctgaagttttaagtactttagtactgaacgtggtagataatccaattaatgctttatttaacgcaaactttattggtatcttattttgggcaataggtttggggatagccttacgctatgcgtcagatacgactaaaaatgtcatgaatgatttttcagaggctgtatctagaattgttcattttattattagttttgcacctatcggtgtttttggtttggtagctgaaactttaactgataaaggtttgggtgcattgcttgattatatgcaattactagttgttttaattgggtctatgctatttactgcatttgttattaatccaattttagttttttggaaaattcgtcgtaatccatatcccctagtatggacttgtgtacgagaaagtggattaacggcattccttacacgtagttctgcagcaaacattcctgtaaatatggaattgtcaaaacgcttaaaattagatgaggaaacttattcagtttcaataccgttaggtgctaatatcaatatggcaggtgcggcgattactattacggtattaacgttagctgctgtacataccttaggtattgaggtctctttccctacggctgtattgttaagtgtagtggctagtatttgtgcttgtggtgcttctggtgttgctggcggatcattattattgattccattagcttgtagtttatttggtattcctaatgatattgcagcacaagtaatcggcgtcggtttcgtcattggcgtattacaagattcaacggaaactgcattaaactcttcaacggatgttatttttacagctgcggtatgctggagtgaagaaaataaaaattcatagagtttatctaatgtgaaatatagcgggtatgggtacatatccgctttttcattatacttgatagccttctgcatgaagtgataaagtagaaaaaatttcatctacgatgagaatgctttagcatcactgtactttttgctttgaaatggagatatccctctcataaaaacactatagttttcataagaataagttattttcaaaatatactagtaatccatatggttattaatttttacaaaaactttctgttcaataatttaaaaaagaggaatataataggatacactagtttaatagtcaggagagaaatatgtatatcagtcggaatatggaacaatggaatgaatttcttgatttaatgagaaaagcatttgaacaaggcaaagaacaagaactacttaccttgctacttactgctgatgagcgagatgcagttgcactacgcgttcaaattgtatcccaattactggataaatctttggcacaacgagagatacaacaaattttgaatacaagtgcggcaacaattaccagaggttcaaatatgattaaaattatgccacctgaatttatggactgggttaaacagcaactaaaccataacaataaaaacgaattaggtagtgattaataaaagggtagtaagagtgagaccttaagtcatttttgtttactattttcctgtacaaatgcacttctaaacagaaaacagtctttactataaaaaatttacgtcaaaaaaatctgacagtttcatacttaaagagaacgctgccagatttaatttactgtatagtatgatgattatgcgttattaccagtgattttagccacttccgctgcaaaatcttcttcaactttttcaataccttcaccaacttctaaacgaataaagtttgttactgaagtattaactgattttaagtaatcaccgacagaaactgaaggatccataacgaatgcttgaccggttaaagacacttcaccagtgaatttcttcatacgaccttcaaccattttttcagcgatttcttttggtttgcctgagttgattgcaatatcaatttgaatttgacgctcatgttctacaacttcagcggaaacatcttctggatttacgaattcaggtttagaagctgcaacgtgcattgctacttttcttaattcttcttctgaaccggatcccgctactaacacaccaatttttgcaccatgtaagtattgagcaattacatcaccctctaaatactgaacacgacgaatcgtcatattttcaccaattttagcaactaatgcagcacgtttatcttcaaaatgagttgctaaggtatcaatcgttgttcctttgtttgctaaagcgtaatcagcaacttcatcagctaaacctaagaagccggtatcttttgctacaaagtctgtttcacagttcagttcaactagaacaccaaaaccggaaccaatgcgtacacgaataacaccttcagcagctatacgacctgctttttttgcagcttttgcctgtcccgatttacgcatattgtcgatagccagctcaatatcaccatttgcttcaactaatgcttttttacactccatcatacctgcaccggtacgttcacgaagttctttaactaatgctgctgtaatttcagccatcttaaattcctctatccatttgattaaatagtatcggttttagaccgcactttatcgatataaaaagcagggaactaaaagccccctgcgtttaattaataagggcttacgcctttactgaattattctgctgctgcaaaaacttcttcagttaccgtttcttgattacgaccttcttttactgctgtggtagctgcagaaagatataattgaattgcacgtgacgcatcatcgttacctggaataacaaaatctacgccatctgggcttgagttagtatcaacaattgcaaatacagggattcctagattatttgcttctttgattgcgatatgttcatgatctgcaccgatcacaaaaattgcatcaggaagaccgcccatatctttgataccgccaagacttaattcaagtttttccatctcacgagtacgtactaacgcttcttttttcgttaatttatcaaaagtaccatcttgagattgggtttctaaatcttttaaacgtttgattgattgacgcactgttttccagtttgtcaacatcccgcctaaccaacggtgatttacataatattgctgacagtctaacgctgctgctttaacaacttcagaagctgcacgttttgtaccaacaaataaaattctgccgttattactcgcaatacgagttaattcaactaacgcttcattaaacattgggacagttttttctaagttgatgatgtgaacaccattacgaggtccgaaaatgaacggtttcatttttgggttccagtaacgagtttggtgaccgaagtgaacgccagcttgcagcatatcacgcattgaaacttgtgccataagataattttccttttgtttggggtttagcctccacatatcaagcaaatcgaccgtttggcaccccgatttacttctcatgatacgtgtgtgatttcgtaagttaattgttaaattgacaactcaaaataacgtcgcactttataccacaaagtgcggttaaaaactagaagaaactcttaaattttgcaaaaaaataatgcccgataacctcaggcactatttttacaattcgaagaaatgtaaacctgcttttactcttcattaatgaattttgtattaatttcaatactggctttttctcttaaggcttgaataagcaaattgcttaaactaaattgcttaatttctgctatttgaacgccaaataattgtttttgctcaggcgttaattggctatcttctacgttcattaactcaacaaaaacaatatctccaaacatatttttcgctacagatatggttgttttgcccgggtcaggttttttcattgagaatatcactttgcctaaaacaggatctttattatctgcatctctataaacccacgtttctttttctgaaaaatgaatataagacggtaatttgaaatcagttattgtattcatctctgcaacgattttctctgccatattaaacaacgtagtttcggctttctgacgttttaaataagtttcaatatctgctgttgcctcagctagtgtacgaataccctcaggtttataatcaactacacgcagaagcacggaatgttgatcgccaacattgattgcctctgagtttataccgccttgcataagatcagaattaaaaatggcggtagcaatatgactataatttaattctggcggtaaatcttgacgagaaaaataatctgtttctttgatgtcaagcccagctactttagctgcttcttctaatgattgcggattttcaaacgccttttcattcatttgtttttctaatgaataaaaagcatttgttactaaatcattacgcaatttagttgcaatttcctctctaacatcatttaattcacgggttttcatatccaatactttaatgatatggtacgcattatccactttcacaggttggctatactcaccaacatttaataacgtcacagcactttcaaaagcaagaggcatcattccattcacaacccaatccaaatctccaccttttggggctgacaatgtgtccattgaatataattttgctaaagcagcaaaatcttcgccattttgtaaattagcataaactgattgtgcttcttgttcagtcggtaattgaatatgagctaaatgttttgttatatattgagctttattatcttgataatattgtgcaatttctatatcggagatttttactttctgatccgcaatcgcacgagttaagtctagatattgcactttaactctttcaggtacagcaaagttagctttgttagcttgataatattgttcgatttcttgctccgttacagtttgtttttgcatttcgtcatctaaagatagaacagctaaacgaacatcacgacgttggaaaaaattctttgctaattcattgagttgtataggaacctgaaaatcactatttgcaataccttgctgcaattgctctaataccaagccttcacgcacatatgcagcataagtatcagaactaataccacttgaagctaatatctgctgataaattttattgtcaaatttgccctcattttgaaacataggtgagttcacaatagctaaacttacttgcttatcgctaattcctaacttaagttcttgtgcatattgacgtaataattcttgattgattaaacgatcgagaacttcatgtcttagatgtttagctgccgaatctgcaacttcagcaaatttagctcctaaattttcacttaaacgttgatattcattgttatattgctgtagaaaaacttgttgagaaatttcttcgccatttacttttgctacagatgtatctgtccgtataaacatataacctgctacgccactgagtacaaaagaaaccccgattaagccaaaaataattttagaaactataccgctagaggcattgttcaatttttccattaacattgaagaaatcctataaatgttagattaaaaagaaatgcgtaaaattataatcgaaagtaactcaattcgcacgattaaaataataattcatcaacaaaacaccttattttatagattgaattaattctgtggcagtgcataagatacggtatcttagaattatgataaaaatatttaactgatctaaagtagtttaaaagtgcggtgctaattcatgacttttacgagtcatacataaaaaaagagtggatttcccactcttttaaaaaaaaacaaagtcttatctttttatcattcaaccactaaagcacggcaagtactcgtaccatttgatgttaagtggtctccttgagttaataaaaccaaatcaccggaaactaaataacctttatcttttagcgattgtatggcagcttttaatccttcaagcgtacgactatcctgatcaaaatgaattggaataacaccacgatacaatgcacataaatttaatgtactttcatttcgagaaagggcaaaaattggtagtccggaactaatgcgagacatcaattttgcagtatgaccactacttgtcattgcgataatggctgcaacacctttcatatggttggctgcaaacatcgtagacatcgcaatagtttcttcaatcgtatcaaattctttatctaagcgatgccgagaaatatttacactaggcattttttcagcacctaaacaaactttagccattgctgaaacagtttctgaagggtattgacctgctgctgtttccgcagaaagcatgacggcatcagtgccatctaatacagcattggcaacatccatcacctcggcacgagttggcataggattgctaatcatagattccatcatttgtgttgcggtaatcactacacgatttagctgacgtgaacgacgaattaattttttctgtattccgactaattccggatcaccaatttcaacacccaaatcaccacgagcaaccataattacatcagaagctaaaataatatcgtccattgcctcctcgtcaataacagtctccgctctttcaactttagccacaattttggcttttaaacctgcttgttgagctaattcacgagcataatttaaatcagcactggaacgagggaaagaaacagcaagataatcaacaccaatacgtgcagctaaaataatgtcttctttgtctttttctgtcagtgcgttagcagatagcccaccacctaatttattgatacctttattatttgataatggaccgccaacaattacttctgtaaatactttagtattgtctgtcgataacacttttaattgaacacgtccgtcatccaataataaaatatcgcccggaacaacatcttgcggtaatgttttataatccagtcctacggcttcttgattaccttcacctttgggtaaatcagcatctaaagtaaaattatcaccaatatttaagaaaattttaccctctttaaaagtagatacccgaatttttggaccttgtagatctcctaaaattgcaacagttttacctaattttttagcaatttcacgaactttttcagcacgagcaagatgatcttctggtgtaccatgagaaaaattcatacgaacaacatttgcaccggctacaataattttttctaaattattacctcgatctgtggatggtcccagtgtacatactatttttgttcttcttagtcttctagacattcgttactccgtttaattattttgaataatataagattattaatttagtaaaacccgctcattatatgcttaaaataaaattagatcgagatcacattttggaaaattcttatcataactggataatggaaatgaatattcagattttttctctttttcttttcataaatgttaataaagtaaggcttttatatattcttgaaaaaatttgttaatcatcaaccgcaccaacacacaaaaaaagcagtgattgctcactgctttttcacggtcattgaatgaaacctaccaggtccagccaacccctacaccaccgccgaaatcaccggcagagtttctgctaccatgtaatttcagcattattttaccattatcgctcaaacgcgaataacctaatgccaccgcattgtttcctttataggtacctgcagataaagcaaggctcgatttgcccggcatcgttactgtaggcaatgcggcagcagcatgtgctccagcaaccccggctctcaagtctttattgaatatctcaattttattgtcgagatggttgaatttttggtcagtatgtgtctgcaatctctcgacatatcccttgttgaccacggcattcggcgatgagttcggtgttaaatcaggcacacggatttcgccttttgcaccgtcaatctcaactttctgaccttgtccgtttgtgaacgttaatgcacttgatgtcaaagtagccttgttattaccttctttgagagtgatctcccccgaaccataatgtgcagactgattgtttttacctgtcactgtcaatccgttgccgtcaagacgggatttattcccctctgcggtttctttggtttcaaaagaggtcatatttttcaaggtatcggacaacttcacttccataccgctgtcagaagcagtcactttaatattgccggcagcggttgttgcactgttaaactcnccctcgcctttgatggtcaatttctcgcctaaatttttatggacaggcacgccgtcattgccctcaaaatttaagcccgcttgtcctaargcytgyaagtcttgcaagtttgccccacggtgaacatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtttcaagagcgtcaatggcgtcctgtttcgcctcttttgctgtttgtagcgtcaacatatcgtctacttttttcgccaccgcctgtgcttcggttttcactgcttcgcctgcatttttcacgtttttagcttgctcttttgctttatcggcatcaatayccaamccgctcgccacgttgcccagcactacagrkttatcggtttcaccaycggtattgaccagagaaagttgcgtatytaccrcacttttatcygmtttcggtgtagcgttatcctcaacatctycggctttatagtatttaccrtcrttrgctttgaccaracgwtyrccktcwtyatcggtaaacaccaccgytcccgcytcgccrttrcgyaaagcgttcgctttgtcgttggcatttttgccatttaaaccgtctttgccggttaagcctttcgccgccatcgattctttgccgtctgattttttttcaagacctgacaatccatctttaccgtccgcaaagaccattatcttcggttttggagcggtttcagaagaatttggatcatcaatccatttcgccccagtggctttcacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcttgtagaatttaccatcttgacctttaaccactttttcatcgcccagataataatcaaatggtctatttgaattggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctttacctttgacagttaagccgtccttatcataaacagcatgggttttatcgccattagttgcgtctttatcacccacggttaaacctttatcgttcaaggtcgcaatggttgttttaccgtctttatctttcaaggcgatttcatcacctttgatatttactgtattacctttgtcgttcttaaactcggcagacttcaagccttttaactcctcattgagagaaatttctagcttgctcttagcactatccgttttcaccgcaatattgccgtcggtgcctttgaaatcagcggctttagctttatctaagccttgacctacaatttccagtttttcaccaaggtttttatgcacaatgctgtcgctgtcattgccggcaaaatccagtcctgcttgtgcgacagcttttaagtcggcaacattcacggctttatgcgatgaatctttatcaaactcgcctgacacgagttttttcaccaactcacgttgtttgccttgtgcagctgaagcaatgccactgtctttaatatcatcaatacccaaaccggatttaaggttatcaatcgcaacaggtgcaactgttttgcctgcttcaggtttaccgcctagagtgatggatgtttttgtgtcatcatcatatttcaccgccactttctctgcttcggagtgttgtgcggtgactttccctacaatagccttggcaaccgcagacaagtcttgaacattgacagcattnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttttaagcccagcccactcgcaagtcctttaatttgtttggtatttaaggttaatccggttctgtcaaagacaaaggttccaccattggattcaatgacaacattagtttttggttttgtaccattcgctccttgtttgttaaattcaatgctagaagcgatttttttacctttgccagctccgatttctcgacctccaatagacttaatgcctttcaaatcagaattgagagcaatttctagcgtagaggaatctttcttcgctgtggtagtgatattttgatgtgttttagccgaacctgaacccaccttacctttaattttcaagctgtcattaacggtaaatttagagcctttattcccctcaacttcaaattttgttgcatagttcattaatttctctgccaccgcttttgatgtaaccactcgttcatcgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagctatcaatggtcaatgttccgcctaattgtaatgtggtttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntattagatcctaataatatattttcatttccttcaatattattactagaacctatagatatattcctatttccaaatattttattgttcgaacctattacataggttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttttaatctcttgtctaaatattttttgttgacagcatagttatcataagtatttttcttagcactatctgacgtatcctcaggaatttcttctgtaattaatacatttttaaaagtaggggattcttttatacctattaagatatttttattatttttttcatactgagttctaatattatcacttaaaaattnnnnnnnnnnnnnnnnnnnnnnnnnnnnnnnnnntatattcccagccttaatgattaatttatcgcctaggtaatgtgttccttgttcatcgccatctccactgccaaaaayaaagccwntattaatcgctgttgtattttgaccaatggcatctttaaaggtcatttctgttggtgttgaagcagttgttttcccattatatttagcgacttcaaattccgattttttaaatcccgttttattagcgtcttcaacttccgcacccaatacattcaccgctaattttgaaaattcatcggcgacggcgtaaagttggcttccgttgatagcgtcggttgaatctgacgttaccgcaccagcagcgacgtgtttaatgatacgctcattatttttcttacctatgcttaacacggattttttattattttcttgaccattagcactcactccacttttgaaattaaatttaacattaatagcctctattttagcttcattaagtgcggtttcttttttagtcgcttctgacccttgtcccaacgcaatggartygccrgcggyggyttcaaccaccgcactttgtccaatggcgacaccgccctcggctttagattgggcttgataaccaataatcactgcgttttttgctcctgaggtggcttttgtttctgctccaataagtacgctgttttttgcattttgggcattagctttattaccaattgcaaccacatgtgtattagcatattcgtcagaaccattattctcaaatcctatattaatattgttccctaacgccagtatatcggtcccgttttggattttgtttttattcccgatagaggttgtccatgctgcttttttgatgatagtaccctcagttccatctttaccattcgcaaaaaccgcaccgatggcaatcgaactcttggactcttctaattttgttccgctaccgatcacaacgaccgcacttcttacatccttattagtttgtgtaactgtattatyrgawcccaacacaaaagarttwgstacatcaacactgacatttgtccctatgacgatagcgttttgagcttttgaacttgccccttttcctatcgctataccagcactagctgttgcactcgcatctacacctatggctacagaattgcttcctttggcaccatcattgtcataatttgaaccttgttgagtaggattattcaccgacaaataatgcaaagttcctacattttttacgcctttcatcgcttcttttaattgagcaaggataacaacgtctgtgtcctttgtacctggtgcgacgttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcttagcattttgtcctataacaatagagttgtcagaatttgctaaagctcctacaccaattgccatcgaacctgatttttttgctctatcgctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcttttctcgctttaagttttaaatattctcttttaattttaatatagtttttataatcctgttcttttgtgactaataactttaagtcatctaagcctttgacagagacatatttcacgccggaattaatattatcttcttctaacgtatttccatacaggatagcttcttctaaggctcttaattgagatacgttgaccgcatcggtatcgctcgcacccggtgcaacattgacgatacgtctttccgcattctttccacccactgacaaatagccgattctttctgatgaaggtattgatatggcatttttaggtgcccatccgccttgtgccatttcagtttgagtataatcagtttttgcattgacgcccaatgcgatggaatctgaaaaagaggcttccgcaccattaccaattgccattgcatttttaatggtaaaatctggtttgctatttttcttatttttttcacttcgaagtgcggttggcatttcagctaaaactttagcttttatacctaatgccatagaatcatcagcttttactaatgaatgagtaccaaaagcaactgattgtttacctaatgctcttgtgaaatttcctattgaaaatgaagattctttttgtgcaaacgcaaatctaccgagtgcaaccgtactatcttctttcgcataggcatatctacctaatgagattgcattatcccccaatgcaacagagtatgaacctatggcaatagcaccttgattatgtcttcccaacttatctttagattgctctgctttttcttcgcccgttccttcttggacggttgtgtgggcattaatatgctctttcattatatcttgtatcgctgctgtatcaccgatacgatataaatcttcgatggttattttgttattttgtaatccttgtggaccgtcattagcgtattcagggtaattttgtttatcttttgctaataagttatatcgatcaataccaagcccttcaccattaaataggttacccatcttcacattggcaaaggtgtgatcaccaatcgctaacgatcctaagccccctgcaaaagagtctttaccatataccatagatccggcaccgatggcttgtactttattcccgatacctacagatccatctgcatagacatagctgttattacccatcaccaatgaacctttaccaaaggcgacggtgtttgagccgatagcggttgaataatccttagccgctacagcaaatgtccctaaagcggttgaattatctccataggcaattgaacgtgccccaatagcaatggcattatttcctcttgcccaagtatgtgttttggtatttctatgatctgctaaatatttttgataagcctctccttctttttttagatagagttcatatcttttataatcgcttagggactttatctcttttattttagcctcataccctggggtgttaggatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctcacaaaatatgtgccgttttgatatattggtgtgtaaccatcttcagctaataactgccctttatcattaagcataggctgacctctatcatctttcataatctcaaaatcaacggcagcatattctttggtatagttaaaatcatctcttacattataaaaaagtctaaacatctctttagaaagcggtttggcatcctgccctgcgacattatcgcttccgatagaaatggaggaatctccccatgccatcacatcgttacccaaagcggtcgcttcttcgcctcgtgcaaaagatcgataaccgacagccgtaccttctttatttaaagctattctaggatcttttttgcgtttctctttctccattgttatcacttggttaataatgtttcgttttttttcttcttctgtaagtttccacttaggattattggcaaaattaaaatacttttcccgtaagtctttatacgaatcatcgtcgcctctgagcagaatagatttagcttcttcatacgtaacgattggattgctagttgaagtcgctgtattttctccggtagcggctccaaaaccgatagcggttcctttatcaccgcccacgactgctcgagaccctatcacaacagtttgattaaagtctttattgctatacgaagcattttttcctgttttattagcataatccgagaggataaccgcttcatcgggaatatcagattgtctatatggtttattccaagatccatacataatttgcgttttacggtttagggtgcttatcgtttgtccatctgcaacatcagcactatgaacccaaacatcatacccatacgccgctctcgataacagcccactcatcaccaacgccaacggcagaaccttaaacgcccctaacataccgccgaaaaacacaccgcacttcggctgacttcccgccgcctcaacacggctcgccacttggcggttattcgctaattcagacactactttagtttgaccggttgttacatcgtatttggttttgaagattttgttcataaattcactctctttaagcttttaaaattaggttttttattgatttattttgttgattttttaacttttacggttgtttattgattaaacgttttgctttttagatagattgataaataaatcggcgatgccttgctttttaagacacaacaaaaaaaggcgaataatactttcgccgaaaggttgaggttgaaataggtgatttttatttttaagatattgtttgaacatgtccaacctctcaaaattaacttgaaaggttgattttagccaatatactaggctgtaggctgtaggctgtaggctgtaggctgtaggctgtaggctgtaggctgtaggctgtaggctgtaggctgtaggctgtaggctgtaggctgtaggctgtaggctgtaggctgtaggctgtaggctgtaggctgtaggctgtaggctgtcatttttttcgttctattttatttgtcaagtaaaaattcgggttattctatctcaaaattgttatgggaaaaacgattttttatttttttattcacttttttgtttgttatcagctaaaagatattttttggcggcggctaaatattgaaacattgaccaaactgtcaacatggcggcgatatacaaaaagacaattgctgtaatttccattaatgtattgtagtgccataaaagaccgccaagtgcaagcatttgtgaggctgttttaattttccccagccaagaaaccgcaacgatgccacggctaccgatttctgccatccattctcgtaatgctgaaatcacaatttcacgaaagatcataataattgcaggtatcgttacccaaaaaacatgttgatattcaacaacgagcgtaagtgccgcaatgaccatgactttatcggcgacaggatctaaaaacgcaccaaaaggcgtactttgattccatcggcgagcaaggtaaccgtccagccagtctgttattgaggcaatgaaaaaaataatagttgtgagaaaaggtgcccaatgaaaaggcaaataaaatgttacgataaagaacgggattaatccgactcgaaataaagttaagattgtaggaatattgaatttcataatgctgttttgagtagagtagggatacgctgtattctaaagtatatcccttatttttaaaagcctgatgaaactaacaaagtgaaataattagttgtttttgatatgggattttaacgtttgttcaatttcataaatccaatcgagttcatattgagtaaaaccggcttggatacgagcatcagtattaataactcctttaaaaatcacgatgcgatatttacgtaataattcgctgaaacatttcattgcatctaattgacgtttagcggaaagtgcgtgataccaatgattcccaatagaaacatgaccaatttcgtcacgcaaaataatatctaaaattgccactgcctcgacgtctttacgctgtgcaattttttcttgtagtattgggtttgcatctaatcctctggcttccaaaactctaggtaccaatgccatacgctcccaaatgtcatgagccgtcgcttgagccatttcccataagccggcatgtgcttcaaaatcaccgtattgatatcctaatgtgtttaaatgctcattcacgagagtaaagtgagtgctttcttcacgtgcaactttgagccaatcttgtataaatagcataccttgcttaagttcttcttgtgcattacgtccaaatctccaagcggcatctaaaccaagatttatggcgttaaattcaatatgtgcaatggcatgtaatgttgccgcataaccttcgtttgtggcaaaagaacgtttcggcacattttggggagcgacaaggaagggtttgtgtggaataccgacaatttcttgttcaggtgtaacaagaggaaaatcgtccgtttgatctagatttatcgtaggcaaaatttcatcatataactgattcactaaacgacatttttcataaggatccgtttctgccagtgcggttgttattttatgccaaaagtcttgagttgaaagtgcggtcatatttttccttatttcatagaataatttttaatcgctcaaagtatagttatcagagaaagatttgcaatcggaatttgcttataggataatgcaccccattagccgttcggttaattctatggaaatcttttcggttcctcgcaatagtgtccgatttactcggtcaggttcggaagaaagcagccaaagtcggaatttctgtgtgccgagatcctgccggaaaggtttccgcccatctactacatttcaatatgtataaaaaaagcaacttttcagttgcctttattcaatttagctttgttcttttactgcctctaatgcacgcaaggcataagtataagccgcaccagcgttcagtgcaatcgcagtagccaatgctccggcaatttcactttctgttgcccctgctttagctgctttttcagcatgaacactaatacaactttcacaacgtgtcgtaatagcgacagcaattgcgatgagttcacgggttttttcatcaagtgcttcagccgcagctgcctgatctaagttaatataggcttgtaacatttttggatgagacttgcccaattcgccaaaagattttttaacatgagcggtatgctctttccaatctgtgaatgttgtcataagaatttcctcttgttgttaatcaagttaatgttgataattaaccgcacttttataacttgattgactaaaagtgcggtgtaatttgaacatattttttagatttaaattcgttcaataagttgtttaaaaaatcctttttcttgttgaatcagttgatggtagtgtccttgttcaactagatggctgttatccatgatacaaagtaaatcgaattgttcaagtgctgttagacgatgagtaaccataatgaacgttttattttgacaatgttcaaataatagcgttagaacatggcgttcagtatctcgatccagtccttctgtcggttcatcaagtagaataatgggggcattattcagtaaaactcttgccagtcctaagcgacgctgttcaccgcctgataaaggtcgcccgccgtcgcctaaccataaatccagtccttgatcctgctgaactaatttttccagacctaccttttgtagtatatgacacattttttcatcgctgatttgttggctacctgctatttgtaaattattgcgtaaagtatcactaaaaatatgtactcgttgagtgagtaaacagatattttggcgtagcgtttcttcggtataaacttgaatcggtgcattagagagtaaaatttccccttggttgcaatcatagtttcgaaccaataattgcagtaaacttgatttgccactccccgttttcccgagaacagccactttttttccagcttcaacggttaaattaatttgttgcaatgcctgatcattgcgatccggataagaaaaactgacatttttcagttgaataagcggatattcattgttttgcaatatgtgagtaccgttgaattgcactaaaggtcgttgtgcaagaagttcattaatgcgttctgcagatgaaatgacttgtccaatatgtaagaatgcggcactaataggcatgagaagctcaaatgaggcaagagcggcaaacgcaaataacgcaataaaagcattgtgataatctgcaatggaaaattgtgctttcgccgcaaaccaaagggttattactaccagtaatccgttaataaatacgacaagtgcggtagataatccgactaaatttgtttcttgttgttggtaagattgccattctaattcgattgcttttagtttctcttttgagctaaaggctgcattaaagagtaacagttccgcttgcgactgaataaattcgataaaataagtgcgataaactgaacgagattgagttaatttagcaccgaatttacgtcccagccgataaaaaacgatgggaataattaaaagtagcaacagcaggcttataccaataaatacgccgatagaaacattaaataaacttaagcataatgtaataaaagcaataacaatcattgcactgataaaaggggcaataaggcgtaaatacaatgtatctaaagtatctacatcagccactaaacgattaagtaagtcactgttgcgatagcgattaagtactgcggggcttaaaggaataagtttactgaatacttgaacacgtaattttgccaatacacggaaagtggcatcatgcgtcactattttttcaaaataacgtgttacagttcgaccgattgctaaacctctgacacttgccgacgggtagaaaaaattaaataatgtgccaataccggctaacgccgtggcggcgagaaaccagccggatagggttaataaaccgatgcttgaggctaatcccgcaatcattaatattccccctaaaatgagagtaaatttagcgtgataaaataagcgaagaaaaggaagtaaagctcgcattattgaatttcctgtttttgttgagccaaaagttcggcgaagaaaccttgttcttttaattgttcaaaacggccttgttgcacaatttgcccttgttgcatcactaaaatttggtcgcattgttttagatcttcaatgcgatgcgtaatcattaaagtagtttggttacggctaattttttgtaacacttgtagcacggcattttccgattttgcatcaagacttgcagtaggttcatcaagtaataataaattgctttgacgcaataatgagcgagcaataacaagacgttgtgcttgtccaacggataaaccaataccgccttctctaatcagaaaatcaagtcctaatttcgcacaaaaagacgtggcttgtgcttgttctaatgcttgcataatttgttcgtctgttgcttgaatatcaccaaaaagtaaattttctcgaatcgtgccttgtaataataaaggattttgccctacccaagcgatattttttcgccattcgtttaaagataaatcatgcaattcaataccattaatttttaaacttccctgataatttaagaaaccgagtaacacgttgattaatgttgttttacctgcaccgctttgcccaactaacgcagtattgctttgagcagtcaagcaaaaatttaacggagcggttaaaggatggccttgtggtgaaagtgcgatgagatttttcgctataatttcgaccgcacttttaggctcgatactatgtgtttgttcatattgttgagaagtaacttcttgctccaaaaatttaacgatttcatcagctgcaccaatacctgctgcacgatcatggtaataagcacccagatctcgtaaaggttggtaaaactcaggagcaagaattaagcagaaaaagccaataaataaagtaagttcagtgtcgtaagaaccgaagttaatttgtcctaaataactaaaaccaaaataaactgccattaatgcaatagagatagaagtaaaaaattctaatactgcggaagataaaaatgccatttttagcacagtcatagttgtttcacgaaaatcttcagtgctttcttcaatatattcagtttgctcttttgttttattaaaaaggcgtaatgtttctaatccacgtaaacgatctaaaaattgaccgctaagttttgctaaggcggacatatttttttgactactatctgcggcggctaatccggctaaaatcataaaaataggaataagcggagcagtaagtgccaagattaatcctgccgcccaattgagtggaaagacagcgattaagataatgattggtgtaatggctgaaagtgcttgttgaggtagaaagcgagcataaaaattgtgcagattttctacttgttccagcatcaaggttgcccaacttcccgcagatttttggttgatcattgccgggccagcttgatgaattttggcgaaaatttgttgacgaatatgatgacgtaattgttgaccgcatttaaagcccactttttcccttgcccataatattaaaccacgtagcataaaaccaagaataagtgctagaaagtgcggtattaattcacttcgatccgtatttaaaataatgagttgatgaagcaggtagcttaaaatataagtttgtgcaactaaaacaacggatgaaatagttgcaagaataatattaagcgaaagcaactttttgattggcttttgttgtttgcgtagccatttgaaaacatacttttgacgtgatttttccattgttactgctagaggttatgatatatttgtggggcaaattagttgccccaatatgactgagttaattatttttgtgtatccaaaaaacgttctgcatctaaagctgccatacatccagttccggcagatgtaattgcttgacgatagttgtgatccattacatctccggctgcaaaaactccttggacagatgttgccgttgcattaccgtccaaaccggattttacgacaatataaccgttgtttaattcaagttgattggtaaacaattcagtgttaggagcatgaccgatcgcaataaataccccttctaatttaagatcttcaacattttctgtttgtgtgttttttaaacggattccggttacgcccatattatcacctaaaacctccgctaaagtgcggttcgtatgcaggataatttttccttcttccacttttttattgaggcgatcgattaagattttttctgcccgaaacgtatcacggcgatgaattaaatgaacctcagaggcaatatttgcaagatataaggcttcttcaacagccgtattaccgccaccaaccacagccacaggtttattgcgataaaagaagccgtcgcaagttgcacaagcggaaacacctcgtcctttgtaagtttcttctgaaggtaagcctaaataacgagccgatgcacctgttgcgataatgagtgcatcgcaactgtaagcccctgcatcaccaaatagtttgaatggacgttcagataaatcgacattattaatatgatcgaagacgatttcggtatcaaatttttcagcatgttgcaacattcgttgcattaattccggacctgttgtatcaccaaagtctcccggccagttttctatttcagtcgtcgtggttaattgtccaccttgttgtaatccggtaaccaatacgggttttaagtttgctctggcagcataaattgcggcagtatagccggcaggaccggatcctaaaatgagcagttggctatgtttaaaatctgacataaaaatccttgttagtaaaatcttgcaagattgtgggttcgcttattatagagatttcaataattaaatctatcattaaatagaaatccatagtggctattatgttgctggaggcactatttttaacattaatatttgactgtgtgtccataactttcaatgatagatttgatatgttctagagaatctttagttggagggactacatcttccagttcatattgttcgcccatcgttttccatttatgtgcacctagctgatgatagggtagaagttcgacctgttcgatattgctcatattttgaataaattgacctaataagtgtatatcttcatcagcatcagtataaccgggaacaactacatagcgaatccaagttttttgattgcgtttttgtaagtatttggcaaattctagtgtacgcttgttcggtacaccgataagattttggtgcactttatcattgagctgttttaaatcaagtaaaacaagatcggtaacatctaataattcatcaatgacatgatcataatgacgtacaaagccatttgtatccaagcaagtacttattccttctgctttacaggctttaaaccaatctcgaacaaattcagcttgtaagacagcttctccaccggatgcggttacgccaccgcccgttgcattcataaaatgacgatacgtgaccacttctttcattaaatcttctacactgatttctttgccatcatgtagatcccatgtatctcgattatggcaatatttacaacgcattaggcagccttgtaaaaataaaatgaaacgaattcccggcccatcaacagttccacaagattcgtaagagtgataacgtgcaagtacagacatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgcggataaagttggatttcccaaaaaacgtattattttaggtggagatcatcttggtcctaactgctggcaaaatgaaccagctgaacaagcaatggagaaagcaaaggtgcttgttgccgaattcgctaaagcagaattcaccaaaatccatttagatgcatccatgtcttgtgcagatgatccggttcccctaccgccgttagtagtggcggaacgtgctgccgtgctgtgtcaagcagtcgaaaatgctctagattttgcaaatcgggataaagttagttatatcataggaacagaagtcccggtaccaggaggtgaaactcatactatctcaagtgttgatgttacaacaattcaaagtgccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttggtcacacctctgtagtatctgcaagtttaatctttattccgcttactatcctaattgctgtgttcttaccgggtaaccaagtacttccatttggtgatttggcaactatcggcttcttcgttgcaatggcagtagcagtacaccaaggtaacttattccgaaccttaatttccggtctgattattatgtcgatgaccctttggatcgcaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaatggcggtaattatatcatgcactattaatttgtaacttattctttggattgctcgggaataatgacccctaaatcgatccatttgtaccaagtttgttgcagaaattgtagtatgttttcgtcaactgcaaggttttttaaagattcttttagcttttgtagtgaataggctttttcttgtaacagcattaataaaaagtgatctaagtccgttaacttttggtaatacacttcaaattgagcattacgccaaataattgtttttgaaggttgatttagtattttgctaaattgagttgaaagaaaatccaccggatattctcttataaagcaaacttctgagcatttcattggagtttgttctgttatatcgaattcagtcggtagctgaaacattgatacttccgcttgaagttgatcaaattcaaattgcattagggagagaatattttcatcgaaaatatttttgtgttggcaaaattgtaaaaactcacctgcaatatcttggaagtaaggggaatgtgcttttccgtttttgacaaattcttcttttgcattatcccaatcttgtcggtttaaatgagccggagtttcggtaaagcatttttcgataaagccaaaagtattgttgcgtaataaccgcacataaatatttaaacgtctaggatcgtgattgctagagtctttttcacgaatagcttgaacaaattcttgttgcgtttgtgctagatttttagccatgacaatcctctttttttgacatatttttgttgtaattgatggataatatcgacttctttacaaagtttttcaaaaggggggaaattgaaatcacgttcaagtagtgttggtggcatatgaggtaaacgagcataagtatattcaagtaaatcccaaacagtaccttttacattttcaccatgtgtatcaacaagtaattgaggaagatggcgaaaatctcctttgattgtattgaaagactctgatgtttgtatttgcacttcagtagcggcatgttcatcatcatgtccggcaatatgaatgtaattgacacgttttaaatccacattatcaataaagacatgaggatcaagtaatccatggttgaccgcatttacatagatattattaacatctaaatgaataccgcaatttgcctcttgtgcaatagcattgagaaattctacttcattcatcgtgcttgtttcagaatgcaaataataagaggtgttttctactgaaatttgaatttctaaaaaatcttgtacttcacgaattcttgctgcagtgtgttttactgcttcatcagtaaacggcattggcaataaatcatataaatgaccatcgcattcgcaaaagctcagatgatcggaaaagaaaggcgtattatattgttttatcatggctttaatgcctgataacaattctttatctaaaggggcttgtccaccaagagaaagagataacccatggattagcatagggattttttctgccactttatcgaattgataacgcgcaaatcctcccatttttaaccagttttccggtgctatttccataaattgaattcgatcattattgcgtaattgtagaaatccttccgctagatcacgtctgtagcctaaaccggcaccttgtcgcatatatcctccgtgtaaataaaaagggtgcgatgcaccctcaaaaatttatttagatgcaccgcactttccttcgccacatttgccttcggcagatttcggcatgttttttttaggtgtagctgcaccgcactttccttcaccacatttgccttcagcagattttgatacgcattttccatcgtgcatttcacagtcgtttgtagtgttcttcatgtctgcatgtgctgacacagccatagttaatgcactagctagtgctactaaagttgtttttttcatggtttttctcctatataaatgattaaagtaaattcagccgtttttgagctgagtattttttccgtaacagaaaatcaagtgaaactacacccgcaccttgtaggagcagaggaagtaacgtaattatgtaaatgagcggtaatttataaccattgttgcatacgttataacctaatccgctatgtactgttgcccaagctacagcggttaaaatcatcaaccctaaagcactaaagcgagttgcaatacctaaaaccaacaaaatcggaaacaataattctgcaccggttgcaatagcccaatttaagtccagtggtaaaattgagaaaggaaacggaaaattatcttttatcgcataaaaccaattttcaccgttccatttttctagtcctgcttcgaaaaactcataggcgacaaaaaaacgtaatacgagtaaggataatccctgagtggattgtttaaaaatatgacaatgagacattttctactcctaaaaaattgctttctagaagttagacgaatgagaaaataaaaccttacaaaaaaatttcaaaaatttagaaaaataaaaaggtcagattttactctgaccttttaaatattctgatttaaaacttacattgacgttgtgaatgtacgtgtaattacatcttgttgttgctctttggttaaagagttgaaacgtactgcgtaacctgatacacgaatggttaattgcgggtatttgtctggattttctaccgcatctaataacatttctcgatttagtacattcacgtttaagtgttgaccgccttcaatagttgtttcatgatggaaatatccatccattaaacctgccaaattgcgtttttgtgcatcaatatctttacctaacgcattaggtacgatagagaacgtataagaaataccgtctttagcataagcaaatggaagtttagcaacagaagttaatgatgctaccgcacctttttgatcacgtccgtgcattgggtttgctcccggtccaaatggtgcacctgaacgacgaccatcaggtgtgttacctgttttcttgccatataccacatttgaagtaatcgttaaaacagattgagttggtgttgcattgcggtaagttttgagtttttgaattttcttcatgaaacgttcaaccaagtcaaccgcaatatcatctactcgtgaatcgttgttaccaaattgtggatattcaccttcaatttcaaagtcaatcgcaacattttttgaaataccgatcacgtcgccagctttatttttcacttcaatatcaccacgaataggttttactttagcgtatttaattgcagaaagtgagtcggcggcaacagaaagaccggcaataccgcaagccattgttctgaatacatcacgatcatgcaatgccattaacgctgcttcataagcatatttatcgtgcataaaatgaataatgttcaatgcagtgacgtattgttttgctaaccaatccataaagctgtctaaacgggtcatgacgtcttcataatctaaatattcagttgtaataggatcggttttaggaccaacttggtcaccggatttttcatcaataccgccgttgattgcatacagtaatgtttttgctaagttcgcacgagccccgaagaattgcatcattttacccacgatcattgggcttacgcagcaggcgattgcatagtcatcattttggaaatccggacgcattaggtcgtcattttcgtactgtacagatgaagtatcaattgatactttcgcagcatagcgtttgaaaccatcaggtaaactttcagaccaaagaatagttaagttcggttctggtgaaggtcccatcgtgtaaagtgtatgcaagatacggaaacttgttttggtgactaaagtacgaccatctaaccccataccggctaaagtttcagttgcccacattggatcaccagagaataattgatcgtattcaggcgtgcgtaagaagcgaaccatacgaagtttcatgaccaagtggtcaattaattcttgagcttcttgttctgtaattttgcctgctttgagatcacgttcaatgaaaatatctaagaatgtggatacacgaccaaaagacattgccgcaccgttttgtgatttaacggcagcaaggtaagcgaagtaagtccattgaaccgcctcttgagcattttttgctggagcggaaatatcatagccgtaagatgctgccatttctttcattttgcctaaagcacggtgctgttcagcgatttcctcacgtaattgaatcgttgcttgaatatcttcgccgctctctaatttctcttgtaatgaagtaaattgtttgaatttatctttcattaagaaatctgcaccataaagtgccatacggcgatagtcaccgatgatacgaccacgaccgtaagcatcaggtaaacctgtgattacacctgatttacgacaacgtaaaatatctggtgtataaacatcgaatacgccttgattgtgagttttgcgatattcagtaaagattttttcaacttctggattgagttcacgacggtaaactttacatgagcctctaaccatgttgatcccaccaaacggcataattgcacgttttaagggagcgtctgtttgtaaaccgacaattttttctaaatctttattgatatagcccgctttatgagaagtgatagtggatggaatatctgtatcaatatcataaggttcgtgagttttgttctccactttgattttttccattacatcagcccacaggattgatgttgcttctgttgcttccgctaagaatgcttcatccccctcatacggagtatagtttttttggataaaatcacgaacattgacttcagtttgccaatctccaccgacaaaaccttcccaagctttttgttgagtttctgttaattgagccatcgctaataacttccttttgagtaaataaaaataaaactgttgaactttgtaaaaacaatcgaaaaacagaccgctcttacaccctaatgatttattagtgtctatgaggtttattggtaaaccattgcattaatgcaatacaaacaccgccaccgataatattccctaaggtgacaggaattaaattcttaaagataaaatggtaaatatccaaatcggcaaattgcagaggattaagattaattgcttgccaaaaatctgttgagctggcatgtgaggtaattattcccattgggatcataaacatatttgcaacactatgctcaaagcctgaggcaacaaatagacctataggcaaaatcatgatgaatgctttatctgttaatgtttttccggcataactcatccaaacagcaatacataccataatgttacatagaatacctaagcaaaatgcttcaagccatgtgtggtgaattttatgttgtgctgtttttagaatggttaaaccccattgtccatttgccgccatagtttgaccggcaaaccaaattagtaacacgataattaatgaaccgacgaaattacccaaataaacaacaagccaattttttagcatttgagttgtggtaattcgtttattcacacgtgcaataagagacatagttgatgatgtgaaaagctctgaaccgcatactaccgccataataataccaagagagaaaaccaaacctccaacaagtttggtaagtccccaaggggcattacccgaacctgtctgagtagtagtgtaaaaaacgaaagcaagggcaataaatgcacccgcagaaattgcagataagaatgagtagaattgatttttagttgctttataaacacctacattctcacctatttgtgccatttcgctaggtgatactattatggttgtattttcggttttcattacaaaccctattgaaattaaactggcgttattttaagtcattaaccggaaactttaaactaaaaaattttttattttttataaaatttgttaaatgaaaatatttttaacaagtgtttaacatttaattgttttatattttttaaatgcaacaacttattaacattagcaatctaaattgctatttaaagggatttctgatacaaaatgcacctattatttttatatcatgggagaacaaaaatggtagaagaaactatttttagcaaaattattcgtaaagaaattccggcaaatattgtttatcaggatgaattggttactgcatttcgtgatatatccccacaagcacctacccatattttaattatcccaaataaaattattccgacagttaatgatgtaacatcagaagatgaagtaacgttgggacgtttatttaccgtagcggcgaaacttgctgaaaaagagggaatagcacaagacggttatcgtttaatcgtcaattgcaataaacatggaggacaagaggtctatcatttgcatatgcacttggttggcggtgaacctttagggaaaatgttggcaaaataatgaaaaatttacttatcgcttttattttgagtttgggattaattgcttgtggttctttggaaaaagtaaatttagtgcattctcaacaaccaattataaatattagtaccgagcttgcttctgatattgacgtacaagtcagccattcatcagcatcgctgacaaacgtttcacaaaagcaagtgacgctcgtatattattttttttggtacgataaaaatggtgtaacacaaggtgatgtggctaatatgaaaaatgccactatgctgattttatcgccaggtcaaacacgtcagttagtattacaaaagccgacaacagaaagtgtgaattaccgcctttacttgagtttatagaacaaaatgtcgatattattaatagatttatcgggtcaagagttacgtcaagaagaaatcgaattacttgaacatcctctagtcgcaggattaattttatttagccgcaatttttatgatattgagcaaatccgacatctcattagatcggtgcgtcaaaaggttaaaaagcctttattaattactgttgatcaagagggtgggcgagtacagcgttttcgtcagggttttacgcaattaccggcaatgcagtcctttgcctgtttactttctgaccctcaagagcaacaggaaatggcttggcgagctggttggcaaatggcggcggaaatgaccgcacttgatatcgatcttagctttgcacctgttttggatcttgggcatcaatgtaaggcaattggcgaccgcagttttcattatgaggaaaagaaactgattgaacttgctgagaaatttattcaaggtatgagacaaatcggaatgtcggcaacgggtaagcattttcccggtcatggacatgtgttagccgattctcatttggaaacaccttatgatgatcgagcaaaagaattaatttttgcacaagatattcgaccgtttcagtctttgattaaacaagggttgttagatgcagtgatgccggcacatgttatctacactcaatgtgataatcaaccggcaagtggatcgtcttattggctaaaggaggttttacgtcaacaattgggattccaaggagcgattttttctgatgatttgggtatgaaaggtgccggttttatgggggattttgttgctcgttgtacgcaatctcttcaggcgggttgtgatttattgttgttatgtaacgagcctgaagcagtggtgcaagttttagatcgttttaaaccacaggaaagtcaaaataaacgaataatacgccaaactagattgaataaattattcaaaaaacaacggattgattggcaaaccttacgcgctcaacgtgattggttggaaaatcacaaaaaacttaccgcacttcagcaagattggttagcctataagggctatgacaattagaaattatggaggtggttttttgagagtatacaaaaataaagaagaactcaaaactgaaataaataaagcatttaagaagtatattttagaatttgataatattccagaaaccttaaaagataagagagttgataaagttgatagaactccagctgaaaatcttgcttatcaagtgggatggacaagtttggttcttaaatgggaaaaagatgaaagaaaggggcttcaagtaaaaacaccatcggatgaatttaagtggaatcaacttggtcaattatatcagtggttcacggatacttatgctcatttatccttgcaagagttaaaagcaaaattaaatgaaaatattaattctatctatgcaatgattgattcgttgagtgaggaagaattatttgaaccgcatatgagaaagtgggctgatgaagcgactaaaacagcgacttgggaagtgtataagtttattcatgtcaatacggttgcaccttttgggacttttagaacaaaagtcagaaaatggaagaagacagtattataaattacctttttacaaaaaaatttcataaaaacagttaccaaaggcaatagagaaaactatcgttttttcctttgcaaatttaaattttattaaattaatatgaatttaattcatgaaaagtataatttttctgaaattgacacatattttctttctctttatgatgattttaaccgatttaaagataaatttattatggagtaaatgaatatgagttataccaaagaattagatacattaaatcagcatatggttgatattaatgggaaaattaatgtttcttttgagttttttccacctaaaaatgaaaaaatggaaactcttttgtgggactctattcatcgtttaaaagtccttaagccgaaatttgtatcagtaacctatggagcaaattccggtgagcgggatcgtactcatactgttgttaagcgtattaaacaagaaaccggtttagatgcggcaccgcatttaaccggtattgatgctactccggaagaattaaaggctattgctaaggattattgggatgggggtattcgtcgaattgttgctttacggggtgacgaacctaaaggttatattaagaaacctttttatgcctccgatttagttgagttattacgttcggtagctgactttgatatttcagtggctgcttatcctgaagtgcatcccgaagcaaaatctgctcaagcggatttaattaatttaaagcgaaaaatagatgcaggagcaaatcatgtcatcactcaattcttttttgatgttgatagttacttacgttttcgtgatcgttgtgcttcaatagggattgatgcagaaattgtgccaggcattttaccggtaacgaattttaaacaattacaaaaaatggctgcgataacaaatgtcaaaattccaagttggatggcgaaaatgtatgaggggttagatgatgaccaaactacaagaaatttagttgcggcaagtattgcgatggatatggtgaaggttttatcttgtgagggggtaaaagatttccatttctatacactcaatcgcagtgagttaagttatgctatttgccatactttaggcgttcgcccaagtttataaaaaaccgcactttgagcctaaaaaaggactaaattgttaaaatttggtccttttatttttacggattttattaagaaatgcacaatttaaaatggaatgtcatcatcaagtggagcatcaacaggtgatggagatgcaatgctcggtttaggttgagaatgtgattggtaggttggttgctgttgaggttcgtatcctcccatttgtccacgatctgaacgactatccagcatttgcaatacatcgccctgaatttcagtggtataacgatcttgaccattttgatcttgccatttgcgtgttcttaaacgtccttctacataaacttttgagcctttgcgtaaatattctccagccacttctgcttgacgacgataaaacacgatgcgatgccattctgtaatttcacggcgttcattggtatttttatcaatccaactttcacttgttgcaacactgatattcgcaacagcatcaccgtttggcatggtgcgaatttcaggagcgttaccaagatttccaacaatgattactttatttactccagccataagtcctctaatttgcttcagttaaaaagtgcggttattttgccttaaattaaaaaaaaaagctatgcttaaaatgaactaaactggatatttgcacagttgtttaggaatgtgagataatgatcgcaaaatttacttgattggcttgctattattgtcaatttattgttggtgtattatggaaaaaattgatattcgtggggcaagaactcacaatctaaaaaatataagtttaacaattcctcgtaacaaacttgttgtaattacggggctgtctggttcaggaaagtcttctttggcttttgatacgttatatgcagaggggcaacgccgttatgtagagtcattgtctgcctacgctcgccaatttttatctttaatggaaaaacccgatgttgatcatattgaaggattatctccggctatttctattgaacaaaaatccacttctcataatcctcgctcaacagtgggaacgattactgaaattcatgattatttgcgtttattgtttgctcgagtaggtgagccgagatgcccagaacatcatgttacattaagcgtgcaaactattagccaaatggttgataaagtactgagtttgccggaagaaagtaagatgatgttacttgcaccggtggtcaaaaatcgtaaaggcgagcatatcaaaattttagaaaatattgccgcacaaggctatattcgggcaaggattgatggtgaaatttgcgatttatcggatccgcctaaattagaattacagaaaaaacatacaattgaagtggtggttgatcgctttaaagtgcggtctgatttggctactcgtttggctgaatcttttgaaacagcgttagagttgtccggtgggacagcaatcgttgcggatatggagaattcgcaagtggaagaattgattttttccgctaattttgcttgccctcattgtggttattctatccctgaattagagccgaggttgttttcttttaataatcctgccggtgcttgttctacttgtgacggtttaggcgtgcaacaatattttgatgaaaaacgtgttgtacaaaacgcatcgatttctttagccggtggagcgataaaagggtgggatcggcgtaatttttattattaccaaatgttgatgtctttagctaagcactatgattttgatattgaactaccttttgaaaagttaccgaaaaaaattcagcaaattatcttaaacggttcaggtaacgaggaaattgaatttcaatatatgaacgatcgtggtgatgttgttcttcgccgtcatagttttgaggggattctcaataatatggctcgccgttataaagaaaccgaatctatgtctgtacgagaggaattgtccaaaaatattagtagtcgaccttgtgtagattgttgtggttcgagattacgttcggaagctcgccatgtttatatcggtgaagctaatttacctgatgtatcggagaaaagtatcggagaagcactcaattttattgataacctgacattgacgggacaacgtgggcaaattgcagacaaaattctgaaagagattaaagagcggttacaatttttagtgaatgtggggctgagttatttatctttatctcgttcagcggaaactttatccggtggagaagcacagcgtattcgtttggcaagtcaaattggtgcaggactagttggagtaatgtatgtacttgatgaaccctcaatcggtttacaccaacgagataatgagcgtttattaaatactttgttgcatttgcgtaatctaggcaacacagtgattgtggttgaacatgatgaagatgctatcatggcagctgatcatattattgatattggtcccggagccggtgtgcatggaggaaatgttgttgcacaaggtaatgcacaagaaattatggctaatccaaattctttaacaggtaaattcttgtcaggtaaggaaaaaattgaaattccgctgaaacgaaccgcagttgataagcaaaaaatgcttagattaaaaggagcaagcggtaataacctgaaacaggtgaatttggatattcccgttggtttatttacctgtgtaacaggtgtatccggttcgggaaaatctaccttaatcaatgatactttatttccattggctcaaaatgcgttaaatcgtgcggaaaattcccagtttgcaccttatcaatcaattgagggacttgagttttttgacaaagtgatcgatatagatcaaagtccgataggtagaacgcctcgttctaatccagcgacttatacaggactatttacgccaattcgtgaattattttccggcgtgccggaggctcgagcgagaggttataatccggggagattcagttttaatgtgcgtggcggacgttgtgaagcctgtcaaggtgatggtgttatcaaggttgaaatgcactttttacctgatgtttatgtgccttgtgatcaatgtaaaggcaagcgttataatcgagaaaccttggaaattcgttacaaaggcaaaactatccatcaagtgcttgatatgacagtagaagaagcacgagtgttttttgatgctattccaatggtagctcgtaaattacaaacgttgattgacgttggtttatcttatattcgcttaggtcaatcttcaacaaccttgtctggaggagaagcacaaagagttaaattagcaacagagctttctaaacgagatacagggaagacgttatacattttagatgaaccgactacaggattacattttgccgatattaaacaactcctgaccgtcttacattgtttacgtgataagggaaataccatagtggtaattgaacataatctcgatgtaataaaaaccgctgactggatcgttgatttaggaccggaagggggaaatggcggaggacaaattattgctaccggcacgccggaagaggtttgcctagttgaaggatctcatacggcgagatttttaaaaactatgttggctaaaaaataacatcataaattagaaaccgtacttcatggattcgattttaataaagtgcggttttttctttgctttttataaaaaagttctgttacaaagggtgtttttttgctaaatttagcacaattttttcgttaagctcggtagagcgtttttatacaatttattagcggacttcttatgttattcaaaaaaattcgtggtttattttccaatgatctctcaatcgatcttggtacggcaaatacgttaatttatgtaaaaggtcaaggtattgttttggatgagccttcagttgttgcaattcgcaaggatagagcaggttcacttaaaagtattgcggcggtcggaaaagaggctaaattaatgttgggtcgtacgccaaaaagtattgaagctattcgtccaatgaaagatggtgtcattgctgatttttttgtcacagaaaaaatgttgcaatactttatcaaacaagttcacagtggcaattttatgcgaccgagtcctcgagtgttggtttgtgttcctgctggagcaacacaagtcgaacgtagagctattcgtgagtcagcaattggtgcgggagcgagagaggtttacttaattgaggagccaatggcagcagctattggtgcgaaattacccgtttcaacggcaacaggatcgatggttattgatattggtggtggtacaacagaagttgcagtgatttctttaaatggtattgtttattcttcttctgtgcgtattggtggtgatcgctttgatgaagctattatcgcttatgttcgccgcacttttggttcaattattggagaaccaacagcagaacgtattaaacaggaaataggtattgcttatattcaaaatgatgatgaagtgaaagaaatggaggttcatgggcataatttagcagagggagccccacgcacatttagcttaacttcaaaagatgttttagaagcattacaacaacctttaaatggcattgtgaccgctgtacgtacagcgttagaggaatgccaaccggaacatgcggcagatatttttgagcgtggtattgtattgacgggtggtggagctttattgcgtaatattgatgtattgctttcaaaagaaaccggtgttccggtaattgttgcagatgatccattaacttgtgtcgctagaggtggtggtgaggctttagatatgattgatatgcacggcggcgatattttcagtgatgaaatttagttttaacaacatgaaaagtgcggtagattttaccgcactttttgtcttaactatttaatctgttgtgataaatcaatctttatgaaacctattttcagtaaatcacctcctttaggtattcggcttattttagccgtggtagtttctatcactttaattctgtttgatggcaaaactagtgcaatgattaatcttcgtggttttatggaaactgcggtaggaagtttatattatttagccaatacgccacgtgttatactggatggtgtatcggaaaatttgatcgatacaaataaattgcaaatcgaaaataaagtattacgtgaacaattacgagaaaaaaatgctgatttgctcttgttggatcacttaaaagttgaaaatcagcgtttacgtttattgttaaattcgccattaagaacagatgaatataaaaaaattggtgaaattttaaccgctgaaacggatgtttatcgccaacaagttattatcaatcaaggtgcgaaagacggtgcttatgttggacagcctgttattgatgaaaaaggtgtggttggtcagattatttcagtgggggaaaatactagtcgagtattattattaactgatgtcatgcattctttacctgttcaagttttacgcaatgatgtacgtgtaattgccagtggaacagggcgaagtgatgaattgactttagagaatgtgccgagatcggtcgatattgtaaaaggtgatttacttgttacgtctggacttggggggcgttttttagaaggttatcctgtcgcaattgtggaaaatatttctcgtgatagtaaaaattactttgccactattacagctaaacctttggcttctatagaacgtttacgctatattttactactttggccaacgcatgaagatatgcgtaaagcacaatctctgacacctgaagatgttcgtaaagcagtgcaacaacgtctagaaatgcagcataattcttctacatataaggtgaaaaagactccggtacaggaggaattttttccatccaataatacagatgagtattcagtagatatattagaaaccttaccggaaaatttacctgagcaagagtttctacaaaaagagcagggggatgaaaattaatgaaagtaaaatttttgttacaaattttagtgattagcggtttgtttatttttacttttgctcttgaacttatgccttggccagtaacttttcagagtttcaaaccctcttggctagtgttggttttgctttattggattttagcgattccgaataaaatcagtattggtaccgcatttatattaggtattatttgggatctaattttgggctcgatattaggtgtgcatgctttggttttatctgtctttgcatatttgattgcaattaatcatttggttttaagaaatttatctttatggttccaaggtattctcactattttatttgttatcgctattcgtttttcaatttttttgatcgaattctttttaaatggtgtacattttaattggcaagcgatttttggagctatcacaagtgggatattatggccttggttatttttattattgcgtataattagacgaaaattagatttaagatagttttgttcttgcgaggattaagtaatcacatgccaataatcacacaatttccaatggagttgactttttctaaagttgtttttgttgtgttatgatctccaatgggaccaatgacaactctgttccagttttcactacgtttaattttagcatcgaaaccggcaatagataaacgtgcttgcatgttttctgcttgagcacgatttttaaaagctccacattgcaagccaaatttcttttctggcgaatttacagtagggttgttttgtatagactgtgctgtttgtaccggctttgcggacacaatatctattttctcacgtcctttatcttctttaattcttgcctgttcagccgctttttgctctttttccatttccagcaaaattttcttttgctcttcgcttaaacgaatatcgttatttaacgattgattattatcaacaggaactgttcttgtttctagggctttaatgtaactccatacttcttccggtggggtagggaggacgcttttgggtttttcagattttacgggtacctgtatagttgtattcttcgttttggttttcaaaaaatacaacccagccacaaagccaataatgatcaaaagaatcaaggtaattaagaagattttatgctttccttttgtctgttttttctttttagacttcacacctgttccgtaatcttttgccacaataaaatcctgaataacgagtaagtaataaaaatggcaattctactcaaaaaactataactaatctagtactagctcaaatccagcggatctatatctaaaactaaccgcacttgttgtaatcttaaaaaattttcttgctgaaaagagtgtaaaatttgttgtaattctgctttggatttatgttgtaataaaaggtgccagcgatattgccccgcttttttgctaaaaggtgcttggataggccccaagatttgcaagtttttgcttgaggtattatgaaaataggcggcaatttggtgtaacacttcctcagctttttgtgagtggcgactttgggctttaaacagtgcttgagcactgaaaggcggtaaccccatttggttacgcaaagtgagggcttgttgggcaaagtaaggataaccttgacttaataaactaaccaataaaggatgttccggatagtgggtttgcaagacgacctctccttgtttttcttctcgtccggctcgtcctgcaacttgaacataaagttgggctaaacgttcttctgcccgaaaatcagtagaaaaaagtgcactatccacgtttaacagtgccactaaagttacattggggaaatgatgccccttggctagcatttgtgtaccaattaaaatttggcttttgcctaattgaatatcccgtagatattgttccaattttcctttgcgagcggtactatctctgtcaatacgggtaatcttatagtttggaaaacgttggtttaaacttccttccaattgttctgttcctaaacctgtcgtcactaaatgtgtcgagccgcaatttacacattgcattggaataggcttttgtgttccgcaatggtggcaacgtagaactcgctgatgttgatgataagtataaggcttttcacaatgttggcattctacaatccagccacattcatgacaaagtagaacaggtgcgaaaccacggcggtttaagaacaataaaacctgatttcccttttttaagtgatttttcatcattgtcaacaaggtttcagataaaccgttatgtactatttgtcgctttaggtcgataaccgaatgacgaagtgcggtagtatttcttgctctttttttgagtgtgatgtgacgatatttgccttgtcgtacattattgatgctttccaaacttggcgttgcagatcctaacacgataggaatatccaattgtttagcgtaaactactgcaagatcacgagcatgataacgccagttatcttgttgtttaaatgaaagatcatgttcttcatcaacgataattagccccagttgtttaaagggagtaaatagtgctgatctcgtgccgatgatgaccgcactttcgccatttttagaacgttgccatactttcaaacgttggttatcatttaaatttgaatgtaacacatcaatttcaatattaaatctcgcttgaaagcgttgtactgtttgtggcgtgagaccaatttccgataccagtactaaaatttgtttctcttgttgtaaaatttcctcaataaattgaagatagatttctgtttttcctgaaccggttacgccttctaataaccaacagataaatccggattgaaaggttaattggctgagtgcaagagcttgctcttggttaaggggaaggcgatcgttagtttttacaatagattgatgatttaatttttgttgccaagagatacttgttttatgtatttcttgttcagatatatatcccttactttttaaggtgctccaaacttggttatgaaaaggattgttatttttttctgtgatattgttttgtagataatgtagagcctcaagctgtttttttgctctttttaatttgttgttgtctaatgcttgttgcccctgttccgttagttgaaagaaaaatgttgatttttctaccgcactttcaccacggcgtaatttgcttggcaagctgcttattaatacttctcctaagggaaattgataatagtccgctccccaatgtagtagatgccataattcaggggtaaaaacagaatgatgatcaagaacggagataatgggtttgagttgtgaaatatctatctccgttttttcaggtaactcagtgacaataccaattaatttttgtcgtccgaaagggactaatactcgacagccgacagcggttgaaagggcatttggaataagataatcaaaaaaactaaacagaggaacggcaagagcaactcgtgcaagtttcattatgttattttccttgcgtagtttgtgtgatttcatctcgtttaacttcatcccaaaaaatatccatttcagttaaagaggtattttcgaaggttttgtgtgcttcacgcaatttttgctcgacagcacgaaaacggcgttcaaattttttattggctttacgcaagctttcttcaggattacattttagatgacgacttaaatttactaccgcaaaaagaagatcgccgatttcttcttcaatttttgtttggttgataggatttgtttgatattcctgtttaacttcttctaattcctcttgtactttagctatcacaggattgacattattccagtcaaaacctattttggcacagcgtttttgtaatttttcggcacgcttcaatgctggaaaagcatggggaatattatctaagattgattgatgtcctttttgaatatattcacttgcttttgctttgttccaattttctaatgcctcgtctgcattattggctttttgttctccgaatacgtgtgggtggcgacgcaagattttttctgtaacggtatgtactacgtcatcaaaagtaaaatattgatcttccgtagcaagttggctaaaaaatacaacttgtaagagcaaatcacctaattcttctttcagagcagacatgttattttgctctattgcttcaatgacctcataagtttcttcaattaaacaagtgatcatcgaacgataattttgctttaaatcccaaggacaaccattattaggatctcgtaattgggcaatgatacgaataaaatcttgaatgtggtagctcataaataatctcatgaaataaatagtatttgaaataaggatatcatagccttgaatgaacagaaaaatgaaaatttttttaaatttttagccacactgtcccaggaaatgacgatgaactatcatttgataaatatattgggtcgatgagtgcatctattatgtgatgagtgcaccaagactgacaagcatttttttgaatcaaatattaaaaaattatgctcatttctaaaaaaacattttgacatcttgatgtttttagtttgcaagaaaaaagccatagattaacgaggtatttggtttatggagctgacttttattttttattttattcacataaggaaggtattatgttaaagaaattagacccaagtaaagttgttggacttaaaaaccaatcgaactgcaaaacaattatgacaattggtgtttaagacaagaaataactccagttgagaagacactaggttgcaatctagtgtctttttttattaattagattttaaggataatgaatgaactttaatgatatttataatccaaaccagtctttggcgattgcgttgcatagtgcaaataaccaaaagattgtagattctttttattatttattggatgtgtgtgatgaaatcttggatgtaaacttcaaagaaaatataataaaaggcatagattttataaaatccaattcgatattgagaggtattttatttcactttgttaatcatcttgttaagtcaatttctaaaaatgatattgatgaaataaaagatgtatttatttattttaataattttatcttattttatagctgagaaaaaataattttttctggtgtaggaaatataggtaacttatatctaaatcagtttaataaaattaatgatgatgcctatgagttttcttgtgcacctatcaaggatagtttaattaatgaatataggttaaaaattaataatcttatgaaatttatcagagatattgatttggaaacctatatggaaattgagaatatagtcgatgatatatatgtatttggtgtgaattttaaagatagtcaagaaatgatttattctggtagtgattttgacaaacttggttgtattttctttaatgaagatatttttttagataaagatgatttgtttatcttggataagattatacatgaatccgctcatcagatattattgtctgtaatgatacatgatgaagttgtgctaaattcagatgattagcgttatccatcacctcttagaaccggactaagaacaatgaatggtatatatcatgcagcttttgttttgtatcggatagcaagatcaagattttttaatcaaattattgagagaaaaaatactcaatatccttataatcatttgatttcttattttaacaaaaatcaagaacaatttttggtttgttatgatgttatttctaaaaatggaaaattaacagatttaggaaacgttatcatcgaaaactattataaagaattaaggagtatgtctagtgaaattgacagataagctatctaaaaaaaacattgaattgatgcaaagatttaatgataatgcggtaagaagactaaatgatgatttatatccaatagcaccagatttggtcgaaatgcttattgattcaatttacggtaatgtttatcaaagaggtgttttgagtattaaagaaagacatatagcaacgctatcggcacttattgccattgggggctcagaaaggcaattgtcgtttcaagggtttgctgcttataagcttggtatcacaaaagaagaaatccaagaaatattgatacaaaatgcaatatttagtggatttacgagagcgatgaatgcggctgttgtgcttgatgaagtgtataagaaatatttacaagggaaagatgatgaagcataatgatttttatcgttatcaattagcagaagttatgcttaatactggcataagaactattggatttttgtttgcttggcttatgcttactacctttcatcaacctcagcatttaggcgtttttattggtatttcttgggcgtgtcaggtgttggcattgcttttattttcttgggtgtgcaaccagtctacatttattatttatagtaaaaagttattgttgcctttttgctttatttgttttttgttttttttgacattgttttttgtttataattattttatttttggcatagtttttatcgttagttctgtttttaccattctcttgaatccattggggacgagtcttaccaatgatttgtatgatggtgaagataaatcaaatggatttaaattgcgtggttttgtgaattctattaataccattatttcccctgctatttccggatttattattcactattttaatacacagaagattattgttttttgtatcctattatctttattaagtggtttcttattttattttataaaaaatataaaattacaagaaaacttgggaaaaaaatctaaaaacacccttaaaatactattgaaaaaccctattgaaaaattgatggtttgtatatcattattagctaattttattatcactcctattatttcatatattattccttacaatatatccaacaaatttaatttatcggcattttatatcggtattagtgaggctttctttggtatcggtatgataataggtagtgtttattttctaaaattgtttaataaaaaacttggcagtcatcatagtttggtattaagtatttttttagtgatgataggtattttgttttctgtgacagataatttttatattttttgtttttctttaatgacgattggggttggcgttgtgatgtttaatattaacagtacacatattcgctgtacggcaactcccaaaaatattcgtaccagttttgaatttgtttttttagcgtgctgtattgtatttattcctattggcgtattgttaacgacttgggtattaaataatggagctttagtttatttttatggaattatttgtttgattatgttggttttgtctttaatgatttttaaaaatactgatattgttcacattcatcagcttactgatgataagctggatggttattatcaggttttgtatcccaaaatctatccataggtgtgggtgttgtggtatttggattgtggcactgccttagcaggggcggaggtagagtatcaagacaaacaagtgatcatcgaacgataattttgctttaaatcccaaggacaaccattattaggatctcgtaattgggcaatgatacgaataaaatcttgaatgtggtagctcataaataatctcatgaaataaatagtatttgaaataaggatatcatagccttgaatgaacaaaaaaatgaaaaattttttaaaacgtgatctggtgcaaatttttttatttttatcaatgctagtatagttccaacagttagttaaattcattaagctaaggaggcaattatgtataaacacgtattagtggctgtagatctttcagatgaaagtggatttttactcgaaaaggcagcaaaaatagcaaaacaatatggtgctaaattatcggttatccatgttgatgtgaatttttcagatctttatacgggtttaattgatgttaatatgtcttcaatccaagatagaatttcaactgaaacacatcaagccttgattgagttatcagaacaatctacctatcctgtttctgagaaattgagtggtagtggtgatttaggacaagtcttatctgatgctgttgagcaatatcaggttgatttattagtaacaggtcatcatcaagatttttggagtaagttaatgtcttccactcgccaagtgatgaattcaattaaagttgatatgttagttgtaccgcttagagaagaataaatataaagaatttgtgatgggcagcgtgagttgcccttttttattagcattgaaatattgttttgcataatgcgttattacttcttgagagaatatgaataatcagctaaaaaagttttttataaatgtcaaaaatatgcaacaataagcaggttttttactggatttacaagatataacaaggttttttaatgaaaacaacagcagaaattagacaggcttttttggattttttccatagcaagggacatcaaattgtagatagcagctctcttgtaccggaaaatgatccaacgttactttttactaatgcgggaatgaatcaatttaaggatgtttttcttggattggatacccgttcttatacgagagcaactacagcacagcgttgtgtacgtgcaggcggtaaacataatgacttagaaaatgtcggctataccgctcgtcatcatacttttttcgaaatgcttggtaattttagttttggagattatttcaaacaagatgctattaaatttgcttgggaatttttaacttcaccggaatggctcggattaccaaaagaaaaactatatgttactgtttatgaaactgatgatgaggcctatggtatttggtataaaggagttggtgtgccggaaaatcatattattcgcattggtgataataaaggtgccccttatgcttctgataacttttgggcgatgggtgatacaggaccttgcggtccttgcactgaaattttttacgatcatggtgagcatgtgtggggtggtttaccaggtagtgaggaagaagatggcgatcgttatattgaggtttggaatattgtatttatgcaattcaatcgattggctgacggtacgatggaaaaattaccaaaaccttccgttgatacggggatggggttagaacgcattagtgcggtaatacagcatgtaaattcaaactatgatattgatattttccaaaaattaattgctaaggttgcagaactgacaggggaaaaagatttaactaacaaatcgttgcgtgttatagctgatcatattcgttcttgtgcctatttaattgcagatggcgttattccttctaatgaaggacgtggatatgttttacgtcgcattatccgtcgtgcggttcgtcacggacatttattaggtgctaaagacactttcttttataagctcgtaccggttttgatcgatgttatggctacagccggtaaagatgtaaaagcgaagcaagccaatgtagagaaactgctacaattagaggaagagcaatttgctcgtactttagaacgtggtttagccttgttagatgaggctttaattaacgtaaaagatggtgtgttatccggtgaagtagcatttaaattatatgatacttacggttttccattagatttaactgccgatgtttgccgtgagcgtaatattcgtattgatgaggaaggcttcgagcgtgaaatggaagtgcaacgcttgcgtgcacaggcggcaagccgatttggtgtagattacaataatgttattcgtgtagaagggacaactacttttgaaggttatactgaggctgaaactcaggcaaaagttaccgcacttttctatgaaggtaaatccgttgagagtattagtgcagggcaaagtgcggttgttattttagatgatacaccgttttatgctgagtccggcggacaaataggtgatagaggttgcctgattgcgacaaatatgcggtttgacgtgaaagatacgcaaaaatatgggcaagtttttggtcatatcggtacgttaattcaaggcacattaaacgttggtcaaacaatcaatgctgttgttgatacggaacatcgtacaaaaacttcattaaatcatagtgctacgcatttattacatgcggctttacgtcaagtattaggtactcatgttgcacaaaaaggctctcttgtatcagatacaatattacgttttgactttgctcaacctgaagcgattagccaagaacaattgtttgaaattgaatgcctcgtaaatcagcatattcgagctaatcatttggtagtaaccgaagttatgcctattgatgaagcgaaagctaagggggctatggcattatttggtgaaaaatatggtgatgtagtgcgtgttgtgaaaatgggcgagttttctattgagctttgtggcggtattcatgtaaaacgtacgggtgaaattggtctatttaagattgtttccgaatctgctattgcggccggagttcgacgtgttgaggcagtaactggagaggttgcaattaattggttgcaacaacagcaacagatcttaatgcaaagtgcggatcttttgaagtctgatgcaaattcattagtcgaaaaaattcagcaattacaagataaagcgaagaaaacagaaaaagagttgcaagcactaaaagaaaaatctgcgatgaaggcgggttccgatattgctaaaagtgcggtagaaattaatggtgtttctgttattgttcaacagcttgaaaatatggatgtaaaatctttacgtgttattgtcgatgatttgaaaaatcagttgggatcagcggtaattgcttttgttacgaagaacgaagataaggttaatctagttgttggcgtgacaacggatttaacctctaaagttaaagcaggtgaattagttaatttaatggcacagcaagtgggtggtaaaggtggcggacgtcctgatatggcaatggcgggtggatcacagccggaaaatatctccaaggcgttaacagtttgtaacgaatggttacataaaaatttataaagtaaaaattttgtgttgtggctcacatttttgaatattattcatctctttgtgggaataaataacgtacaatgtaagtcggataacacttcattattatcatgctttattattataacgctttgttatttaaggattttaagcaagatagagatcttataaattcaactgaaatgagagggttatatgctgatattgaccagaaaagttggcgagagcttactcattggcgacgatatttctatcacaatattaaatatacgtggcaatcaagtaaaaatcggtgttgaagcaccgaaagaggtttctgttcatagagaagaaatttatcatcgtattagagatgttaaagatgaacagcagttgtaattggctttttgaacgataagatatggagaaattatgagtaaactaacttgttttaaagcatatgatattcgaggtcgtttgggtgatgaattgaacgtggatattgtatatcgtattggtcgtgcatttggacaatttttaaaacccaaaacgattgttgtcggtggtgatgttcgtttaacaagtaaagaattaaaaagtgctgtaacaaatggtcttttggactcaggtgttaatgttattgatttgggagagacgggcactgaagaggtctattttgcgacttcattcttaaaagctgatggtggtattgaagtaacagccagtcataatcctatggattacaatggattgaagcttgtacgtgaaggttcgcgtccgattagtgcagatacaggtcttgcagatattcaacgtcttgcggaagaaaataattttgctccagtttcccaacgtggggagtataaacaactttcagtattagggcattatattgagcatctcttatcttacattaatttggaaaatttaaagccaatgaaattggtgattaattcaggcaatggtgcagcaggtcatgttattgatgctattgaagcacaattccgagctaagcatgtgcctgttgaatttgtgaaagttcacaataatccggatggtactttcccgaatggaattcctaatccgattttgcatgaaaaccgtcaagatacgattgatgccgtgttagagcataaagctgatatggggattgcttttgatggcgactttgaccgctgtttcctatttgatgaagagggcggttttattgaaggttattatattgtgggattattggcacaagcatttttacagaaaaataaaggggctaagataatttatgatccacgcttaatttggaatacgattaagttagttgaagataatggcggcgaagcggttatgtctaaatccggacattctttcatcaaagaaaaaatgcgtactgttgatgctatctatgggggtgaaatgagtgcacaccattatttccgtgattttttctattgtgatagcggaatgattccttggttgcttgttatggagttagtgtcaaccacaggtaaatcactaggtgagttagtggggaatagtcttgaaacctatccatcaccgggtgaaattaacagtaagttagttgatgcgaagtctgcaatagagcgtgtgcgtgttgcttatgaaaaagaggcagtcagtgtagatgaaactgatggtatcagcattgagtatccaaattggcgttttaatttacgcagttcaaatacggagccggttgttcgtttgaatttagaaacacgaggcgataaacaattgatgacagaaaaaacagaagaaattctcgctttattgcgtcaataaattaaacttaagtaagaccgcactttgtttccgcaaagtgcggttatttatggctctaattaaggaaattaaaatgaaagtaattattcctgttgccggcttaggaacgcgtatgttgccggcaactaaagcaattcccaaggaaatgttaacgttggttgacaaaccgttaattcagtatgtcgttaatgaatgtgttaatgcagggattaaagagattgtgctggtaacgcattcttccaaaaatgctatagaaaatcattttgatacatcttttgagttagaaactatgttggaacagcgtgttaaacgccagcttttagatgaagttcgttctatttgtccgacaggcgttactattatgcatgttcgtcaagggaatgctaagggactagggcatgctgtactttgcgggcgagcaattgttggcaaggaagcttttgccgttgttttacctgatgtattacttgctgaatttgatagtaatcaaaaaacagaaaatcttgctgcaatgctgaagcgttttaaagaaacgggaaatagtcagataatggtttcacctgtacctgataaagatattagcagttatggtattgttgattgtggcggtgttactttaaatgttggtgagagtgttaaaatctcaaatattattgagaaaccctcatttgaggacgcaccttccaatttgtctgttgttgggcgttatgttttttcagcgacaatttgggatctattggaaaaaacaccagttggtgtcggtaacgaaatccaattaactgatgctattggtatgctaattgaaaaagaagtagttgaagcatttcatatgaccggcaaggcttttgattgtggagataaaataggatatatgcaagcctttgtggaatatggtttacaacaccctcaattaggggagaattttaaaacctatttgaaacaactggtgcaggacttgtagaaattcgttatggctaaactttgtcggttctttaatataaaattttattaagggaccgattttttgtgattaaaaactgctatcaattcatttactttaattcttttgtgagatgatttgctaatagaacgctgaacttttaagcgtttaatttttgcgtctttgtagatctctctggtaaatttggtatcgtggttagagattaagaccggtacaccgtggtttagtgcggtatcttttgccagttgagctaaattttgttgatgagataaagaaaattcattacctgaatagctggtaaagtttgagttttgtttcaatggtgcataaggcggatcacaataaataacagaatcattattgatcattgaaaatgcttgttggaaatcagcacaaataaacaccgctctttgtgctttttgggcaaaataacgtagttcagactccggaaaataatgtgttttataactaccgaatggaacattaaattcatttttagcattatatctgcataatccgttgaaaccatatctatttaagtataaaaacaaaaccgcacgttcaaaaatattttgcgataaattaaattcagctctgcgatggtaataataattagcggtattagcttgatcatggaaaaatactggtttgcatgccgcaatataatgttcaacatcttgctttacaatattaaatagatggatcaagtcagggttaatatctacgagaatatagtgttcaaaatgagtatttaagaatacagaaccggcaccgacgaaaggctcaataaggcaagttttatttttaggtaaaagtttgttaatttcctctgttaagcgaaacttaccgcctgcccattttaaaaatgggcgatatttcactaaattagaagaagttcctttgctggacatgaaagattaacttttttttgaacaggtacgaattgcatcaagcacgtattctttgtccgtatctgttgcaacgtaggcttgaccaagtgattttagtaagactaggcgtaattttccagcaagaacctttttatcacgcatcatatgtggtagataatcttcagctttcattgtatcaggtgaggctgtaggtaaatctgtttgagttaaaagtttctccagtctcgttacatcgttaagtgataaatcacctaatttattagacaagaccgcagctatcatcattccggttgcgactgcttctccatgtaaccaatttccatatccaaggtgagtttcgatagcatgcccgaaagtatgacctaaatttaataacgcacgctctcctttttcagtttcatcacgagtaaccacatctgctttaatttgacaacagcgagcaatgcactgctgtaaatattgttgttctaaagcaactaaattagttatatgtttttctagccatgtaaaaaattcatcatctaaaatagcaccatatttaatgacttcagctaaacctgcgtgaatttcccttttaggtaaagtagttagcgttagcgtatcaataataacggcacaaggttgataaaaagcaccgatcatgttttttcctaatttgtgattgacagccgtttttcccccaacggaagaatctacttgagcaagtaaagtggttggaatttgaataaaacggacaccacgttgatagcttgccgctgcatatccggcaatatcaccgatcacaccgccacccagtgcaataatagaggtatctcgtccatgattagcttttaaaagtgcggtaaaaattaagtctagagattctaaagttttgtattgttcaccttctgggagttgcacattctctaccgagcaaccaattttttctaaggtgtctgttatagaggataaataatactgtgcaactgtagggttagttacaatcatcaccttatcgcctttttttagcggataaacttgtggttcggataataaccccattccgatatggataggataactacgttcccttagttctacatttacacacagcattttatacctcaaaatgtaattagattttaagattatcaattaaatcaatgatttgattcgccattaatttggcactttgctcgtctgtcggcaaaataatatcagccacttcttcatataaagggttgcggactttggctaaatcttctaatacttggcgaggatcttcaacattttgtagtaatggacgttttttatcacgttgagtacgttggaattgtttttcaacggtcgtttctaaataaataacggtgccacgagcagataaataattacgattatcttttgatacgattgcaccaccaccggtagaaagcacaatgccttgtttttgagttagttcattgatgatacgttcttcgcgtttacgaaaaccttcttccccctcaacgtcaaaaatccagctaatatctgcacctgcacgttgttcaatttcggcatcagtatcaataaattccatgcctaaaatttgtgctaattgacgaccgattgtactttttccagcccccataggacccactaaaaaaatattacgtttttctgccatttgtacttcttctttacaaataaaattaaaaaattgatcttataaaaaacaaacgacctaaaataaagaggtcgtaaaagatcgcccaaaaataatggagattatctcaataaatgcccccttttttcaacctaaaaggggatttattttaagatttcattaagtgcggtttattttaatactattttaatggttttattatttcattaggttgttctgaacgaatgatccttggggtaacaaaaatgactaattcacgtttttggtgtctttcactttcacggctgaacagtctttttaatataggtatgtctcctaacagcggtactttatctactccttttgtgattgtatcgtgaaatacgccacccaacacaatcgtttccccatcttgtgcaaaaacttgagtattaatttcttgtttatcaatagataccatttcattttgcccataagtaatacgacttccaggggagttttggcttacaatgagatccagtaaaatagtattgtctttagaaatgtgtggcgttacttctaatcctaaaactgcttctctaaactctactttctgttcatcagatttcttgccggtaataacataaggaatttcagttccttgtttaatacttgcactttgcttattcgttgtaagtaaacgagggcttgcaataatttctacattattttctcgttcaagtgcggtaagttctaagtctaaaagtcgatcattaattttggtaatttgtaaagcaatagaacctgcaggtgttgcggtagtagcaaaattgacgttaagttgttccgttaaatgctgaaatccgtttgctgctagattgcctgaaagatgatgagcgttatttgtaggctcaaaaattccccaacgaacccccaattcttttaaattttcatcgctaattgttacaattctcgcttcaattgcaatttgttcaataggttgatccatttctttgattaatttttttaaggcattgagagtttcctgattatcctgaattaagagcaagttacttcgttcatcaaaactaaaagttccatttgatgaaagccatgaaccttgacctgtagtcagtgatttcattacatcagccgctttagcataatgtaatttgatcgaagtcgtcgttaaatttggctcattagtcgattttgacaaattttcctttgtatctaattgtatatttgtctctttttttatgcttctttgtcttttatcaaagggatctctagcagataattccacacttactgtgaataagaacaaaaagaaatataagaaatttttaattaacataggtattctccatgactaaagttgtaaagaaatatcggcttgaatggaaaaatcttcattttcactatgagaaatttgcaacgaaactaaattgagtggaacttgaggtaaaagtgcggttaaaaattgagataaatcggaaaaatagcctttaacgtgaaaagttaaaataggttgatttcccatttgccaatgagattgttcaaataataattttccattatttaacaattgtaatttttgattaatttgtgcaagaggtttattaaactcaatattattttgttgatagcgttcctttaagctggttaatatttgttgcctgtgaacaagtcgagcatttttttcgtcaatttcaacttgaagtttgtgtgcaatttcttgttgctgaatataattgagcgagggataaattgagcttatcaaaattattaagaaaaaaattaaaatttgttttagtgaagataaatttacccattttactaacaaattatcagaatgctgtaacttcatgatctattccttatgttgagttaaacttaattcaaattcaaatatgactgatcttctctgatcaatttgtttttctttaaaggtcaacagttttacatttgaaaacaaattttgttgtttcaagaatttttgtagctgttcaacttcattatttttctccgtttcaccttgcaaaattaatttttcaaaatctaaggacagctcgtttaattccccactttgtaacggaagtttagaaattgttgttaatattgataaaaattgttcattcggtaatttttttaagttttttgatttaccgccataatttctttgtaatgtagaaatgttctgttttatttttgcaagtttattgtcaatttgttgtatttgctctctttttttatctatttcggtgtcaattttttgagttaaataaagtataaaagttacaccagcaagacagataatgaggctggcaagtgatttataaataaacgattttattttttgtcgataaatttcttgtcgccaaggtaataaattaatttcaatattacgcatttattattcctttaattccgttatttgatagagttcatgtcttccccaaagagcatttcctaaagcaataaaaggcaattcggtattaatgatgttccatttatgagtgatattttgttgttcatttttttcacaatagcaccaaacgtgttgaggttggcagttaaaacgttggcagaattcttgataaagtgcggtaatatttttgtcatttttttgtagaacgatggtttgttgtccgatttcttgtattgctatacagccgttacgatcctgatataaatataatgtttccatcttttctttttgggggtgaaaataatggaatgctcgtagtaggctattacttaagcaatctaatgtattaatttttatagggaaaaaacgatgcacataattttgagctgtttgttttctaacaacgtagatagccagttttgcaccttgtgttaattctttatattggtagtcgtaccaaatatcatcgaaatctgtcggcaattcattttctatgattaagttacattgttgttggcattcttgctcatttaacttttgcgtcaatatgattgtttttacccagacgtgctgattgggtaaacaggctatccatgtgcagatattctttgcgaattgtggtgtcaaatcagatagtttaagagggggattatcgtttttagttaaaaagtgcggttgtttttgttcatcaaaccagaggaattgccattgttcatcttgtctatgaataccaatttgtaaaatatttgctgtttttttgttaggtctcatttcatattctctttaataaaatttatattttaaaacttagctttattagctaaatcctttatacttacctcattgattatcgatatatttttttcaaatacattaaataagagagaattttacgatgaggatcgcaaaattaatatttagtaccttactaacgttgattattttagggtgtgttgtagtcggtattttttacattcagataaagaaagatttgcccggtgttgatggtttaaaaacagttgagttacagcaacccatgcaaatttatactgctgatggaaaattgattggtgaagtaggggagcagcggcgtattccggttaaattgcaggatattccacaaaaattaattgaggctgtattggccacggaagataatcgtttttatgaacatcatggattagatcctattggtattgctcgagctattagtgtagctatcagcaaaggaaatgcttctcagggagcaagcacgatcactcagcaattagcacgcaattttttcttaacaccggaaaaaaatcttgtccgtaaaattaaagaggcaattttagccattgaaattgagcatgttttaactaaggatgaaattttagagctttacctaaataaaatttatttcggttaccgtgcttatggcgttgcggcagcggcaaaaacctatttcggtaaagaattatcgcagttaactttatctgaaatggctgtcattgccggattgcctaaagcaccttcaacaatgaatccaatcagttcattaaaacgtgcacaggatagacgtaatgttgtattggggcgtatgcttgagacgaactatatttctaaagctgaatatgatgcggcgataagcgaacctattgttgcctcttatcatggaacacagttagaatttcgagctgattatgtgagtgaaatggtccgtcaagaaatggtaagacgctttggcgaagaacaggcttatacgaaaggatataaggtgttcacaacaattttatccaaagatcaggcacaagcacagaaggctttacgtgagaaccttattgcttatgacatacgacatggttatcgtggtgcggtcactttatggaagaaaaatgaaaaggcttgggaaacagaggcgattgtagcacatctaaaatctttaccaaattccaatccatttattcctgctgctgttctgtccataagtaaaacgggcgctaacttgttgttagcggatggtaagaatattactttatctaacaatgcgatgcgttgggcgggtaaaaaaatgcctaaagagggcgatcaaatttgggtaagacaacagaataaagaatgggttttagggcaaattccggaagctaattctgcattagtttctcttaatagtgataatggtgctattgaagcgttagttggcggttttagttttgagcaaagtaaatttaatcgtgctacacaatccttggtgcaagttggctcatccattaaacctttcatttacgctgctgccttggagaaaggattaactttatcaagtgttttattggattcggaaattgttattcaaaaaccggggcaagaaccttggacacctaaaaattcaccaaatcgatatgatggtccaactcgattacgtgtaggattaggattatcaaaaaatatgatcgctattcgtgcgatccaaatggcaggtgttgatttcagtgccgagtttttgcaacgttttggttttaagtcggagaatatttttgccagtgaagcgatggcattaggtgcagcctcttttactccgttggagatggcaagggcttacgcagtatttgataatggcggttttttagttgatccgtatttaattgaaaaaattcaagataatatggggaatgatgtatttattgcgaaccctaaaatagcttgtatcacttgtcatgatattccggtaatttatggagaaacagagaaattagacggatttaaagagaatacatctatatcggataatgccaatgccttagatttagggggggaggaagtcagtgaaattactgatatacccgaattaaatacggttaataaaaaattagatgaaagtgcggttctctttatggctgaggcgaagacggagcattcgacggaacaatatgcacctcgtgtgatcagtggtgaattggcttttcttattcgtagtgcattaaccagtgcggtctttggtgaagaaggacttgattggaaaggaaccagttggcgaatggcagaacacttcaagcgtcgtgatattggcggaaaaacgggtacaaccaataattctaaggttgcatggtatgcgggatttggtgcaaatctagccactgtggtatatgtcggatttgatgataataaaaggagtttaggaagaggagaaacaggctcggcaacagctatgcctgcatggatttcctatatgaaattcagtttaaacgatattccggaaagaaaacttgccttaccgccaaatatagtggaaaaaaatattgatgttagatccggtttattggcagaaacgggagaagggaaaatagaatattttattagaggtacggaacctaaaagaacattcgttcaacaaggacgtggttactaccttccttctgaaacggatctgccaagtgcggaaccggaagaaattttctaaaacaaaccgcactttgtaaaagtgcggtctatctttcattattttataaggttaagtttatgctaagttatcgtcacagttttcacgcaggtaatcatgctgacgtgttgaaacatattgttttaatgttgattattgaaaatttaaaattaaaagaaaaaggattttattatttagatacacactctggtgtcgggcgttatcgtttattcggtgatgaagcggaaaaaacagcggaatatcgagaggggattgctcgactttgggcaaaagaggatttacccgaggcaattcaacgttatatttctttaattaaaaagctgaattacggtggtaaagaattacgttattatgcaggttcgcccctgattgccgcacaacttttacgctcacaagatcgtgcattgttaacggagttacatccggcagattatcctttgttacgcaatgaatttaaggaaatcaataacattaatacaaagcgggataatggttttcagcagttgaaagcgactttaccgcctaaagaacgtcgaggtttgatcttaattgatccaccttatgaactaaaagaagattatgatcttgtggtaaaagcaattgaagagggatataaacgttttgcaaccggtatttacgccctttggtatccggttgtattacgacaacaaactaaacgaatcatcaagggcttggaaaatagcggcattcgtaaaattttgcagattgaattagcggtacgtccggactccgaacaacgaggaatgactgcaagtggcatgattgtgattaatccgccatggacattagaagatcaaatgaaaaaaatcttgccttatttgacccgcactttagtaccggaaggaaccggtaattggtctgtaaaatggattacgccggaatagaaaataccaatcaaattaatttattcaggcagttggttttttgggcaaatttttagcagaatacataaacttaaatataggagagaaaaatgactaaacattatgattatattgctattggtggtggtagtggcggtattgcttcaattaaccgtgctgcaagttatggtaaaaaatgtgcaattattgaagcaaaatatttgggcggtacttgtgtgaatgtcgggtgtgtgccgaaaaaagtcatgttttatggtgcacaagttgctgaggctattgcaaaatatgcacctgattatggttttgatgttacgttaaatcattttgattttgccaaattggttgaaagtcgtcaggcttatatcgatcgtattcatacttcgtacaacaatgtgcttgcaaagaataatgttgatgtattaagtggatttgctaaattttttgatgcaaaaaccattgaagtgagttatgcaaacggcgaaaaagagctggttacagcggatcatattttaattgctaccggaggacgtccgagtcgcccgacaattccaggagcagaatatggtattgattctgatggtttttttgcgttgaccgaattaccaaaacgcattgcggtagttggtgcgggttacattgccgttgaattggcgggcgttgttaatagtttaggtgcggaaactcatttatttgttcgtcggcaaacgccaattcgtagctttgatccgctgattattgaaactcttgtcgaagtaatgaaacaagatggtattcaattacatacgcaagctattccacaagaaattatcaaaaatgcggataattctctaacaattaaattagaagatgggagaacgcaggacgtagattgtttaatttgggcaatcggtcgggaacctgccactgatgtgattaatttggcttcaaccggtgtggaaactaacgaacgtggatttatcaaggtagataaatatcaaaatacgaatgttgaaggtatttatgccgtcggtgatattattgagggaggaattgaattaacgccggttgcggttgcggcaggtcgtcgcttatctgagcgtttatttaataataaaccggatgagcatttagattaccatcttgttccgacggtagtatttagtcatccaacgataggaactgttggtttgactgagcctaaagctattgaacaatacggtgcggaagcagtgaaagtttatacatcttcttttacaccaatgtatagtgcggtgacttcacaccgtcagccttgccgtatgaagctggtttgtgttggtaaagaagaaaaaattgtcggtttacacgctataggttttggtgtcgatgagatgattcaaggttttgccgtagcgattaaaatgggggcaactaaagcggactttgataatactgtcgctattcacccgacaggctcggaagaatttgtcactatgcgttgataaaagtgcggtattaattaatgaaaaaaggattgttctctaccttagaggtcaatccttttaatagcgtatcttgatttagaaagatattctcgacctttcaaatgattagacataaaaaaaataactgttatactgatcaacgagtggagaattcggtttatcttcaatctatctcctataattagtataagaaggaaaagaaaatggcaaaaggacaatcactacaagatccttatttaaacgcattacgtcgtgaacgtattcctgtatcaatctacttagttaatggcatcaaacttcagggtcaaatcgaatctttcgaccaatttgttattttattgaaaaatacagttaaccaaatggtgtataaacacgcaatttcaacagtcgttccggctcgttcagtttctcatcataatagtgttcagcatcaccatattgttcaaactcaagaaatgcaagcggaagcattagctgaaaatcaaactgaataattttgaatacaaacaagcaattcaaagtatataccacaagtgcggttgattttgcccaagatcctaccgcactttcttccaacataaatgtgcctcaatttgacaaagcaattgtggttcatgttttcttttctcaaaataaaaatctagaggatttacaggaattccaacttttggttaaatcagcaaatgttgatattctttcaataatcacaacctcacgctccacgccacaagctaaatattttgttggacaagggaaggcagaggaaattgctcaagttgttgaacaactcaatgcggatattgtgttagttaatcatagcttaacacctgcacagactcgtaatttagaaagtatctgtcaatgtcgtgttgtcgatagaacaggattgattttagatatttttgctcaaagagcgaggtcgcatgaaggaaaattacaagttgaattagcacaactcagacaccttgcaactcgtttagtccgccgaaaaacaggattagatcaacaaaaaggtgcggttggattgcgtgggccgggtgaaacacaattggaaacagatcgccgtttaatcaaagttcgcattactcaattacaaaatcgcttagaaaaagtagcaaaacaaagaaatcaaaatcgtcaaactcgccgaaaagctgatattccgacaatttcccttgttggttatacgaatgcaggaaaatccactttatttaatgtgctaactcaagctaatgtttatgtggcagatcaattatttgcaactctagatcccactttaaaacgtttaccaattcaagatgtagggaactgtgttcttgctgatactgttggatttattcgtgagttgcctcatgacttggtttctgcgtttaaatcaacattacaagaaactactgaagcaagtttattgcttcatgttattgatgtcgcagatagccgtaaattagaaaatatgttgacggttaatgaagttttaagtgagattaaagcaaaccaagttacaacacttttagtgtataacaaaattgatcaagtcgagaatattcaacctcatattgaatttgatgaagaaaatcaaccgattgctgtttatctttctgcacaattaaatcaaggtttggatttattagttgaggctattcgacaaaaattaagccacgaaattctacatttagagatcaatcttgctgcacaatacggtaaaattcggcattgtttttatcagcttaattgtgttcggcaagagaaaatcaatgaacaaggtgaattcttacttgatgttcaaattgataaaattgaatggcttaaattaagtaagcaatttccgctattgaaacgtttttatgaatcaacagaaatcagcgacaaataaaccgcactttttaagtctatttgacaatgccgtattgttttaatttattggcaatggctgtatgcgacatccctaaacgggctgccaacttacggctacttggatattgctcataaaatttttgtaacaccattgactcgaacttattcattatttgttctaaggtttcaccggcaaattgatcaacattaaccggcaaaatttcttgctctgataagtttaaatcagcaattgccaactcattatttttggctaatgagcaagctcgatataaggcattatataattcacgcacatttccagcccaagtataatttttcagatattgaataaaccgctcattaaagtgcggtactgaaatagaaagtttttcactaatttgacgaataaatatttctgtgagaggctcaatatcttctactctttcacgcaatggtggaatagtcaaacttaaaacatttagacgatgaaacaaatcttcacgcattttaccttgttcaacatagtgttgtagtggaatttgcgatgtgcaaattactcttacatttgcacaatgttctttttcctcgccaacacgacgaaaagtaccatcgtttaaaaaacgcaacagttttgcttgtagctctaaagaaagttcagcaataccatctaataataccgtccctctattggcatattcaaaaaagcctgttgtttcaattcccttatccaaacgaccgaacatttcactttctgcatcttcagcaggtagccccgcacaatttatggcaataaacaagtgatccttacgaggactggcattatgactggcttttgcaattaagtctttccctgttccggtttctccttgaatgagtaaaggtgcgtccaatccggcaaaagcttttgctgtttcaattaacgtctgcatttttacacttttacatacaatatcatcaaaagaaatcagctttgtcataatttaccccatttaaaatcaatcgatttcgtattctaaacgttgaataaaaaatgtaaagaaaaatgaataccaaagataaatatgtttactcttgatctacatcacaaaaccgaacatttacaggttcagtcagttccaacactactactaaagtgttaaaatctcctcaaatttttaaattcactttaatagcgaggtataaaatggcatttcgtatcgaaaaagacactatgggcgaagttcaagttcctgctgataaatattgggctgcacaaacagaacgttctcgtaacaatttcaaaatcggtcctgaagcttcgatgccaaaagaaattattgaggctttcggttatttaaaaaaagccgccgcttatgcaaaccatgatttaggtgtgttaaatacggaaaaacgtgatttaatcgctcgggcttgcgatgaaattcttgccaataaacttgatgaccaattccctcttgtaatttggcaaactggttcaggcactcaatcgaatatgaatgtcaatgaagttgttgcaaaccgtgcacatgtcattcaaggcggtaaattaggagaaaaatccgttattcacccgaatgatgatgtcaataaatcccaatcttcaaatgatacttatcctaccgcaatgcatattgcctcttataaaaaagtggttgaacatacgttaccttgtgtcagacgtttgcaaaaaacgttagcagaaaaagcagaattatttaaagatgttgtaaaaattggtcgtactcatttaatggatgctacaccattaactttaggccaagagttttcggcgtatgcggcacaacttgctttcggtatcaaggcactggaaaacaccttaccgcatttgcgtgagcttgccttaggtggcacagctgttggtacagggctgaatacacctaaaggctatgatgtaaaagtagcggaatatattgctaaatttacagggttgccttttgttaccgcacaaaataaatttgaagctcttgcaactcatgatgcgattgttgaaactcatggtgccttaaaacagttagcagtttctctttacaaaatcgccaatgatgttcgtttattggcttcaggtccacgctcaggcattggggaaattctcattcctgaaaatgagccgggttcatcaattatgccgggtaaagtaaacccaacgcaatgtgaagcaatgacaatggtttgtgcacaagtactaggtaatgatgtcactatttctttcgcaggtacacaaggtcatttccaattaaatgtgtataaacccgtcatggcatacaatttcttacaatcggcacaattattaggtgatgcttgtgtgtcatttgatgaacattgtgcaatgggtattgagccaaactatccacgtattaagcaacaactggagcaatctttaatgttagttaccgcacttaatacgcatattggttatgaaaatgcagctaaaattgcgaaaactgcacataaaaatggtacaacattgaaagcagaagccatcaatcttgggttggtgagtgcggaacaattcgatgaatgggtacgtccggaagatatggttggcagcttaaaatagttcacttattgaacatttaattaaggcgagatgagttctcgccttattttttactacaatagctttaacttaacattattttttataactgaattggttccaattttgatttttgttccgtagttaaaacatctgttgaaataatatgtaatccggttttgttattcagtcccaaatcagcatggaaataatcaggtaatttgtacattgcacctgttataggatcaacaataagtaacccaattaagcctccaaatacaaagtttccaatataccaaccatcaagttttgcttctaacagaaaagtttggcttttggcatttttaccttcaggggtaaaagtaatttcatatttttcgcctttgaaatatccggctcctgctggtaagacaacattttgaggtgtttttccggatgtaataacttttcctgctctattttttatcacaaagtaggcattactagggtttgattgaattgaaacattataatcgcgtttactcacgatagttgcacaaccggtagcaaacatagcgacaaatgctaatactgataattttcttaatcttttcatggataaatcctcttaaatgtgtaaaatggtaacaattatactaatctgtctattagtgttcgaagttagattttaggtaacaatctgtattttgactagaaacgaataagataaattactacctaagttgtgattaaaattacccaatttgtgaggttttcatgacaatgcataataaaattcgcctgatgcgggaagtccgccaatggtctcaagaagaaatggctcataaaatgaatatgtctctaagtggttatgcaaaaattgaacggggcgaaacaaagttgcactatgataaattggttcagattgctcgtatttttaatatgaacttagcggatctgatagatattgataaaggtgtaattttttgtatgaatgagaacagtgattatatttatacaaattatggcaatatgagtgaatcatcgttaattgaaatcgaaaaattaaaactgacgcttgcacataaaaatgagttgcttattcaaaaagaaaaagaaattcaatcacttaaaaagattattgccctgttggaaacttcaaaataaggcatttctctgatgtgtcgttgattggcaagaacaccactttaaaaattacctgttggcgaaatgatatatgttttaattactttgctggatcataatattccgttatgtgttcttttagtgagccggttgtccgaaaaaattcattggctgataaaatagcttaaattttccagcatttcattaattatttaaccttttatctgtttgtctttccctttaaaagtgtcttattttatcaatcatctttgtgaaatttttgagaaaaatttgaaatgatatcaaatgcttctgtaatcattcgcctgttgtaataattgccgactttctttcaaaaattgctctgaatactcaccaaaccattcccgcacttgattaaaacagtctataaacccctgcttgttattatgttcaaagaaatttagactttcttcatagctttgttttagactcttaatcacttccaaattctccgatttgtccataataatatctgcataaagttctgcatcttgagcaaataaacgtccgatcatggctaattcaagacgataaatgggtgaagatagggcaagcaattgtgccaactcaataggttgttttgataaatgcaaaccatttgcaaaggttgaaaaatgacgtaaggcttgtacatacgtcatacttttatcatgctcggttgcatcaacttgataaatttttgccccccaaatttgaatttgctccaaaagccattggtatttttcggggtagcgaccgtcacaacgtaccacaacttgctttgccatactggtaatatcagaaccgaacattggatgtaatcctaatactgcaccttgatgcacttgtaacattttttccaacggttgacgtttgactgaggttaaatctgttaatagcatattttcggttagataaggcttcagacggtcaatcacatttaaagtttgtgcaattgggacacaaacaataactacatttgcattttgtaaaattttatccgcactttgccaatcctgtttctctaagacagcaatttgataaccagaagaagacaaataacgagcaaataatgcccctaattttccctttcctccaacaatgacgattttttttatttcaggatttgctgttttaaaaccgtattgattttctctagtataagattcccgcatcaaacgacgcaaaacatcttcaattaaatccggtgaaacacctaacttttccgcttcattgcgacgagcctgtaccatttcattttcacgttcaggtacataaatcggtaatccatattgatgtttcactttgcctacttttctgattaattctaagcgttgagaaaaaaggtgtagtaattcacgatctaagcaatcaatttctgttcttaaattttttaaaacgtccatagctattttcatcttactaatatagtttgtacatttattattacaatggttgtaaaaaataacttacaaaataaatatcaaatacgcaactaaattttataaaaaaataccgcactttgcgttctgattaatccgcaatcgtttgcttgtgtaatttatattatgctattcttagcattatttttagtaaaggaattcttatgcaagataataaacctcaaatagccattgtcatgggatcaaaaagtgactggtcgactatgcaagaaaccgctatcattttagatagcttggatttaccttaccatgttgaagttgtatcggcacatcgcactcccgataaactctttgagtttgcagaaaatgcagaagcaaaaggttataaagtgattattgctggtgctggtggtgccgcacatttacccggtatgattgcagcaaaaactatcgtgcctgtattaggtgtaccagtaaaaagctcaatgttaaatggtgtagatagtttatattctattgtgcaaatgcccaaaggcattcctgtgggaaccttggctatcggatctgccggagctgcaaatgccgctctgttggcctcacaaattctcgctgctttcgatccgcacttagcacaaaaattgcaccaatttcgccaagctcaaactgacagtgttttgaataattccgatccgagagaataaggctttaatttttcattaggtaatgttgagcaatgaataaaaagccgatagttaaaacatcctatcggctttatgacttggtcagaaaaattaggctttataatttttattcaaagcaaatgtatatcctctcaaactgttgtttaagactttctggtatccatcctgctatccctagcataagtcatttggtttcccaagccattttaattagttgtcttttgacactactaatagttcaatacctttttctctaattttttctctcatttctaaagacaaaccttcatccgtaataattgtatggattttatctaaaccacacacaatattcgggctttttcttccaaatttgctggaatcggctaaaaccacaatttttttcgctgcatcacacatcagagaactcactttatagacctcattaaaagtagttagcccaacgtctaaatcaaagccatcagtaccgataaaaagtatatcaaaggttgaaccgataaaagcagattcagcaaaataaccgtgaaaagaagctgatttttcacgaaatgtcccgccggaaattaataaattataaggtttattcagtactaaaatagcattaaagattgttaaactatttgtcattaaagaaagattatcaaactgctttaagtatgggatcatttgtagcacagtactccctgcatcaaaaatgaccgaatttccttcactaataagcgttgctgctttttgcccaatacgtagcttttgttgaatattgattgctgttttttgtgcaatcggtttatcttctttgtcctctttattgattttttcttctcgttcaagaagttcttcatcaattaagacgacacttccataagtacgtaagacttttctatcttcttcaagtgcggttaaatccttacgaattgttgcacccgtcaatttaaaatgagtagccaaaacatctacttccgttcgcccatattttgctaaaaacgctaaaattagctgtcttctttcaaaaggtttcattgttcctccaatttagcaaaaattggagcgaaccaatctatgctaatatagttttagttttgtcatgacatctaaaagtgaagccattctttcatcggcaattgaaaatttttcattttcataattggaattcaccaaaaatgtagttaaattggctgctttggctgcaattaaaccagtaatactatcttcaataacaatacattcttgtttttcaatccctaatttttttactgctctcaaatagacggcaggatgtggtttgccatattcttcatccattgcactacattgaattgggaagtaatcccacaattttaagcgatcaaaaatggtcttaattacaactggaggcgatgatgtagcaactgccagtttaatatgattagattttaaaaacgctaataattcatacagccctttcaatgctatacctgtttgtgcaattgcactgcaaccattttccaaaattgcttcacttaatttttggttggatacggataagttaaattttttaatccaagtttcactcaattcatcgatccgtttacccctagtgaatttttcacactctttctcggtaattgcgataccaaattcagccaataccgcaatttgagcctttgcccattgaggttctgaatcaatcattaccccatccatatcaaagataacactattgatttgcatcctttttctccattatcgcatttttcaatgaaaaaatattcaaaatgaaataaaatttacattgttttttgatcttaacaactatatccggaagatattgctacttttaacgcaaattgtgagcgtttatcagttggaaaaattttttccggaataatttgatcaagaggtaagccaatgacgtcaactaacttttgtggtctggcaaaaacagaaaaacctttcatgtgaagactatccacaacttttttctcttcattaaatgccaagacaatcaccgattttggattaaaacgaccgctgttacgcccaacagtgatttttcctttcttgcttatttctagaaaagcttggttaaaggctctaatttgtagccagcctagaatagattgcaaaagccacattataattgagaatgtaatcagcaatgtaattggatccatttttacctcttaataaaaagccatagagtctgaataatctgactgtttactcatttagaacatcacttgaccgccagtaatattaattgactgtccagtgcaataagccgcttcttcgctagcatagaattttaaaacattcagtacatcttgataatcacaacctcgctttaaaggtactttatcaatataaacttgctccacttcactctccgagataccaagtttagccgcatattgtggaattaaagattggaacatcggcgatttcaataaattgcctaacattaatgaatgaactgtaatgcctttgtcagcaagatctaatgctaaggattgtgttaagccaacaccgccaaattttgccgcactataaccagaattgtacttacttccgactttacccgatttagagttaatttgaatgatacgccctttaatgccatcacgaatcattaaacgggaaaaatgcttggcagttaaaaagtaacccgttagattcacttttactgataaatcaaaatcatttaaattgaaatcccaaatgggtgaagcttttgcagtacctgcgttatagaccaagacatcagcacgaccaaatacacaatccgttacttttgtcaaagcttcaacgcttgattcatcgcccgcatcaacttgcaccccaattgcatttccttcgccttgcttgacgttaatatcagcagctactttttgtgcattttcgccatttaagtcggcaacaacaatacgatagccagcatccgctaaacctttagataaaaatgcccctagtgtttgaccaccaccgacaacgatggctacttttttttcattattcataatatattcctttaactttcaatttgaaatcatttctaatttggacttaatcacgtttaataactaagatggaactttccattaatgtttttggtggaacaccaacaacatgaacacttcccggaaattccgcttcggtcgccccatcaaaacggaaagtaatgtgtccgagtgcggataaattatccgacgctacactgccaatggcggtaatcggatattcaacaccatcaaattcggcaatatcgccaacttgtaaagcgtcgcttaattcagatggattgtgtaagaaacagtaatcttctaaatcggcaggtgcattttgtttgaaagtgattaacatattgtcgtttagtgcatcatgagcaaaattgccgattttagtaaacgttgttttatagataatcgtcatttgaatattccttttgttttacaagcggttggtttgcaaatttaaccgcttgtaaagtgattactgataaatgaatgcagataccgcccatgcaattaatactgtcggtgcaccagtcaaaaaacgactgactaatacagaaggtacgcccactcgcacagtatcttgtttcgcttctgccattgaaagccccacgggaatgaaatcacaagcggcttgagcattgatggcaaaaagtgccggcagggctaaatgtggtggaatgttccctaaaccgatttgtgtccctactaatacaccgataacttgagcaataacagcaccgggacctaagaatggagagagtagtgggaaagaacaaattaacgcaagagtaactaaaccgagtgagctatttgcaagcggtgttaaaccatgagcaattaaatcccccaaaccggaagcaataatgattccaatcaaggcggaaacgaatgccataaacggtaaaatggttttcaggactgtatcaatagtatcacgtccggcttggaaaaagagtgcggcgacagaacccattcccatacctatttttgccaataaaccattactttgttcggtgatttttttacttgaatcatactcttttgcggtagttgatgaagcaattttttcttcagatatgacagaaagggctgcggcatccacatcaattaacgaaatattattttcttttacggcagaaacataaatatcttcaacaataaattctgctaaaggtcctgatttgccggttgcgtgaatattaatagttggaatgcgacgttttgggtaaagcccacaacgtaatacaccaccacagtcaacaattgcaattccaatttcttctgctggcggttcgccttctttaaaaccatctactgcttcccagccagttaattccaccaatttattcacaatagcaggacgagtgcctccggtcatataaagtatttttttgccttcaataataggtaatgttaatggaccaccccagccaccgttacctttttcaatataaactgctttattactcataatgtattcctctacttttcattccgtttaattagtttagtgagatagattcacttctctatctaatgtaattcccattcttttttcaaagaaagctgtggtaaagtccgtaatccaaccacggaagaagttagtgaacatgccgactaataaatagctaacagctaaaggtccaagaggtaatcctaaagtcgttaaaccactggcaatacctaaataaacgaataattcacctgggttgatatgaggaaataagccgttcattgagtggcagctataagatgctgcggcgtagtaacttggtttataacgctctggtaagaagcgtcctaaacttaacgtcataggattgcaaaaaacgaaagtgccaattaccggtaagatcaaataacgtgaaataggattgcctgcacttttctgtgccagtctttctatacgatcttgcccaataaatttaattaaggcattcattacaaccagtaatgagattaatagaggtaaaataccattcatcattccgactaaggtttctccccctttttggaacaaaccgataaaccattctgctccgtgtgtgattgcttcgatcatacgacctccaattttcaaaataaaacatattttttcatctctgcattttagagacatgtaaatagtaagttattttcattttaaaaattgtgaagttgatcaaaaaatcaaaatttatttcaaaataaattattattgtttcggtttgaaatattgattgagtaatttggacggaaagaggcaccttttgttttaaacacataagaatttaagttaagtaaatgcgaaaaattaagcctttttcatcaagcaattgatgatttattcgtcgcagagacgaataaaagtacactggttttaagtaatggtttggaaatggaaaagggcgataaacccaaaccacttcattatcatcatgtcgtgcgtgataaaatgatgcaccaagcagtcaaacaacatttttagttagaaaaacaatgactcacacacgatggagggcggattaaatcagcaactcttttttattgatgatattcaaggttatcgtgctgagaaaaaatcagttttcaggcaatctgaaaatactttttgaataaatggtcatagttgaattggaaaatatcctaaaaattaaagtgatgaatttttcaggatatttttattttaaacttgacatttaaaaaatgtcatgataataaaacgtaaaaagtttattatggtaagaagggaatgaagaaaaaatatataactgcaattctgttattaatatcagcatatgcttattcatataggattaatgttatagatgattatgatttaattgataaggaatatatagaattttggaatagagatgaacttataaaacagatagaagtattaacaatagaattattaaacagaggttatgtaacatcgaaaattattgataaagaagagaatttagttattattcctggaaaaatacaaaaagtaatattacaagataattcgacaaaaaatgcaaaattaaaaaaggaattattaaatttaaataaattagagggagagatattaaatattcgtgatattgatgaaatagtatctaaatttaaaaaaataaaaggtaataatgtaaaaataagggtggaaaatatcaaaggtagtcaagatagtaatataataatcataaatgactttaaacctgcgatatatcctaaaatttctgcagattattctaaaggtattaattcggattcttatcgtggttttaaatatgttgttggatttggtttcgaacaattaataggtatgaatgacgaattaaatgtgaacttttctctattatcagattatagaaatatgagcttgaaatataaaatacctataagaaataatgaagcaacaatacagtatcagtatacgaaagacattttaaatgaagatgtagaaacaatagaaagagaaatattattgaatgtaaatacggatattaataatatagatttaaataattcgataactataaataataaaaggtttaatgtaaggagaaatacgaatataacaaacaattggttttatgagtttgaaacaagtttagtgtatacaaaattattgaatttaagtggttattatgttcaattaatgttaaaacctaaaataggtataaatattgcggatataagagcatataaaaaaaaggattatgtaattacatcaggtatagattttaatttatattccaaatactatgatttaataacgaatgtgatttataataagaatatgagttcggatagtgtgtatgatcgttatacgagaaaacttaatatatatgggattgataatatcccgttatcaatagcaaagacagataaactcatagttatgaataataaactgaaatatccaatgacaataaacaaaattaatgtaataccatatatcgatgtggcactaggtagtaattttaaagaatattcaactggaatgagcataggttcaaaatttaaatataaacaaacaagtattaatctagaatactcaaggagtaataaaggtaattcagttttaaatttaaatttagggtttgaattttagtgaaaggaaatcttagtgaaaaggagtagttatgtataatgagaaaaaagtattaacaatggtatatttatttgcagtgatatccgctcaagtaaatgcacagaccgtgaaaaatggggacacggaggtagaaaagaaggatggtttcgatataatcaatattaacacgccaaacacaaagggagtttctgttaataacttaaatgaatttaatgttaaagataaagggacagttatcaataacattgagtctactcataaatataagacagttcattttggtgaaatcgatggaaataaaaatataaagactaaagaagcagatatagcagtgttgaatgtgaaggggacgagtaatacaagcttaaattcaactttagaagctgcatcatcaaatccactaaaagtatacatagctaatgaaaatggtataaatgttgatggtggtaaatttgtaaatatcgacaaattggtactgactacaggtgttgttgatgacaatgatatgtcagtgtcggttaaaaaaggtgatgttaatgtttcatcaaaaggaattagcggcgttaaggatatatcgatatatagtgaaaaattagataataaaggtaaaattgctgcagaaaacacaaaaatagtactaggacatagttctataaaaaataatgaaatatcttcattagatgataattatgtgagtgcgagtgatttgggggctatttatgggaatgatatacaaattcagtcgacggggtatacggatattaatgttaacgaattattagcaaaaaataatattaatattaattcaaaaggtaaaattaaaaacaatggagatattatatctggaaataaaatagatataactgctaaatcgcttgaaaataagggggctgtagattttggtaataatacacatgaattaaaatggatagatgctaaaggtaatgtctacactaaagaacaattagaaaaagtgtggaataaaagaatgaaacaaactttaacaccagaatatgcatttctttatttgacgggttctttattaaatcaatgggctactgatgaagaaatggcaaaaaggttaagcccagaggctaatatttttaaaagatttgatgaagctttaaataaatttaatgataaagatacaaatacttttttaattagaaaagataaagaaaaagttaaaaataaacataaacaaagagattttgttaataaaggagatatttatgcaactgagatagatgataaaaaaatattagaagcagttgcagtaagtaatgttaaagccaatcaatctattatttcttcaaaaaacattaaaattaatttgactgatgatttattaaatcaagatgctagtatagaagctattgatgaattagatattaaagctaaagctaaaaaattagttaataaaaatagtttatcaaatgatataacattgaatgatggatatgaaaatttatcttgggatttaatggttttacaaaaagatataagagccaattatgatataatttatgaaaaaggcttggtttctgatcaggcagcaagaaaggctaaaatagctgctgtgaataaatcacaaattaaggctaaaaatatgaaattagatgtagataatatagaacttcacgatgatataaatacaggagcatctattaaagcagataagttagaaacaaattctaaaaaaataagtttaaaaggtcaaagtatagaagctaaagaatataatatgaaaactgatgagcttgttttgaataattcaactatttatacagataatatagatattggtgctaaaaatgttaaacttttaagtaaaaaagataaggaaatagtaataaaaacaggtaaagaaaatttaacaaaagaaattatttctagttcaggtatttatgctaagaataatttaaaaattaaatcaaaagaattgcaatcaaaaggttcaattattaaatctgataataaagcagaaattaatgttgaattactagaaaatcttgctgaaaaagttacaaaagattataaatcatcttatgatatttctaaaacatttagaaaaattaaacataacgaaaaaagtgaaagagcggtagctagttttatttatgcaaaagatttagttttagattctaaaaaaacaaataatgtagggagttatattgtaggtaccgattcaataaactataaatcgggtacaactaagatagatgtcttaaagattaataatgaattagacaaaaattatggtgtagataatggtatattaggtataaactataataaagttaagaagatggaagatgaagcagttgggtctatagttttaagtaaaggtgaaataaaagctaagattgataaagagctagaaataattggaagtagccttaaaggtaaaaaaatctttatagaagctagtgatgttaaaataacttctaaagaacttgacaaaacaacagaaactgaatcaagacaattacttgctggggatttaaaaggtggttttgaaaagaatgctactttagataatatatcagcaaaagtagatatggaattatataaaaatgaaaaaatgatagttaaagaaaaaaaacattcaaaatcagaaattgaaggagaaaaagttacaatagtagctaaaaatgaaaattcaataaaaggttctcaaattaatgctaataatttagaacttaaaggaaaaatagttagaatagaagatgatatttctaaaactgaggttgagaagaatacagtaacggtttcagcgactaataaaattgcagtaaatgaaggaaatttagaaagtgataataaattaataattagtaaaactaaagaaaatttaaatactgaaacttctaattcctcaaatattaatgctaaagctaatgtgaaaatagaagcagacaaagtgttagtgaaaggttctaaaattgaaggacaagaagtagaaataaaatctaaagaaaaagttgatatagttaaatctcaaaccaaagaagattataaaaaggattctgaaacagttacattagggtctaatgttaaattagatgctaaatctgttgcaattattcaaaccttaaagaaaatgtatgatgaaaaagacaatctttcaggatatgctttaaatccagtgtcaggatatcaaaagataaaagaatataaggtaatgctggaaaaaaatattgataacattaaagaattagttgctaatgtttcagataaaaaactagatcctgaatctttaggggtaacgatgaatgttgaaaatagtattaaatacaatactaatcatttaacatcttcaaaatttgataataatgaaagtgaaattaaagctgataaagttacaattaaaacagaagagttatcattagaagcatctaagattaaaggaaatgaagttaaaatagaagctgaaaaagtgagtttagaatctgctgagaaaaaagtaaattcaaacgaaacagatgccagtgttcaagtagctatggtacatgaaattataagtcaaaatacattatttaaaggtgattcaactgttcaaaacaaaggaaattataaaacagaacatacttcaagtaaaatagaagcagaaaaaatagatttaaaagctaaagaattaaaattacaaaattctcaaatagaaacaaaagagggtaaagttgaaactgataaattaagtgtatatgataaggcagataaagaaactaaatatggcgttactctagcaggtatgtataatggaggtacaaaaattggggttgggagtgctacagctaaagtagagcatgatcaaaaagttaaaaatgtatctattgtaaaagttgaaaatggtaaagttgatgttaaaaaagaagataaaaagaaagatatagaagtcaatattgatgttaatactcaattgggattaaatgtagatccaagcggtgatgttaagggtaaagcaagtggtggagcaaaaactaagctagattcaaaaggtaaaaaaattcaaggtacaggttatgtaggtgttattggagatttagcttttgaagatggaaaaatcacagatgtaaatgtgagtactgagcttaaaggagatttgacaattacaccagaaaaatatgttgatgaaataaaattaaaagttaataatcgtttatctatagatcatgatggtcaaataagtaatgatttaactggtaatttatctactgttactcaaattaatactgaaaatatcaaaagcaaattaaatgtaggtgtagacggtaatctagttactaaaaatatggatataattcaaggtggaataaaaggaaatgctggtggagaaatagaagcaatagtaaaaataaatgataccgtcgaatttaaattaagattgatggctgaaggtaatgtaattaaggaacatggaaaatacataaaactagattctgaattatcgtcaaatgctaatttgaatgtaaaaggtgcaactaaaaatgtttccggctacattaatttagctaataattcgagcataaaaattaataacgaaaatggcattaaagattattcaatagataataatgttgatggtaatctaaagtctaaaggaagtataggcgaaaatgtttcaggagacatagacataaatttaaaatcggatttatcgaaaaaaatgtctcaaaatataacaactagtaccgctgttatggggaacggaaatctaaaagttgaaggaaaactagaaaatttagatggaaatatgggattaaatctaaatggaaacgtggcaggaaatgaggcaggattacaagagttaacaggaaatgctaaagctgatggaaaattacatgctcatggagtattggaagcgtttagtggggatgtaacattagctggaaatactgaattaaatgcaaaagtaaatgaagcattgaaattaaagggaaatttaagtggtcattctaatattagtgttgagggacagacagatgtagtaggtggcaaaattcaattaaaacctcaagttaatatatcgggagataatgttaataaattaacaacatttgatacgagtactaatttgaatggatacattgaatcgaaagtgaaaaatgagtatgtaagaaacattaaagcgaacctaaatactatattcaaaactaaaaagtttgaggtggagacttttgaatcaagtcttgatagtgaagttagatctaaatataaggatatagaatttaatttagcttcaggagaaagaatatcattaaaagactatattcaacaaaaaatatctagtgataaataaaagtttaaagaaaagaaaatttttaaaacaaattttgatctgacactaaaaagttggactgctattcaaaggactgattttgatattgtatcggactcagtccttttaattgaatccgttcttcgttgtaatttaatcagttggttatttagtcctcctttcggaggcttgatcaaagagtagttttctgttttataaaattttgggtagtgaataatactcaacgccatatcaacctaatatcaaaacaacatactgaataaacaaattaaaaggatattcctagtgcttgtttcattatttgttctttgacgaaaccaaatcggttagtggtatttaaacctataccacgtactaactttttcaccggattatcgccgttaaagagttcttttagtccctgcattgccactaacattttgactgccgctgttttctgacatcgttcataatgacgcaaatatcggtattcaccaatatccattcttaaagctaaatttttgttaatttcttgtgcaagtataacagcatcttgaaaacctaagttgactccaagtccggctaaggggtgaatagtatgagccgcatctcctactaacacaatgcgatgtttggcaaaactacgtgcataacgtgcagttaatggtataactttgcgttctccacgcacctcgcataatcctaaacgattgtcaaaagctacagataagtttttattaaattcattttcctctgcgtttaagagttcattggcttgttgtggcggtaaagaccacactattgagcataaattttgttgatgtaaaggcaagaaagctaagatgctgtctttgttaaaaatttgtctagcacaattcttatgcgattcggaagtttttacgttgcaaactaaagcatgatgtccataatcacgaaaaatgagcggaatatctgcttgtttacgcacccaagaatttgctccgtcagcccctacaattaattttgccgataacatttgtccatcatttgtggttaaaattgcattgttttcggtgagtcctaaatgatgcggaagtgcggtaataatttccacatttttttgcatttttaccttttgccaaagttgattttgaatcagatgattttcaataatatgccctaaatgctccagccctaaactttgtgtatcaaattgaatttgtgcaaaactatctttctcccaaacatccattttgtcgtatgccgtcgctctaaaattcaataaagcttgccaaacttccaagttttgcaacattttttcgctggctaaatttattgcactcacacgattactaagttgctcaatcggttctttattaggaaatccttcaattacagcaattttcacagggctatttcgcaagctggcagctaaagccaagcccaccatgcctccaccaataattgcaatatcaaatattttcatcgtcattactccaaataaagataagtttaacaccagcctaacgttgctttagcaaaatactgtcgcaataaagaagattgagcaaatgccatcaagccaagattacgcccaatttgtagcggtaataaattattggcaaaaatagagactaaaccatcagttaaaccaataatattacgttgatcggggttgcgttgtttcgcatagttttgtaaaacttgatatttcccccaatcttgttgttgtaaataagcttgcgataccacatttgccaaactcattacatcacgaatacctaaattaaatccttgtccggcgaccggatgtaaagtttgacaggcattaccaactaaggcaacacgatcttgaatatgttgtgccgccttatataaatttagagggtaggcaaaacgtttaccacactctttcagttttcccactcgccaaccaaaacgttgttgtaagcggcttaaaaattgctgatcattaaggtttattatttcttgactatttttgacgcaccaaaccaaagacattaaattgtctttcattggcaataaagcgattggtccttcttcggtaaaacgttcaaaggcacggttttggtgaggttgttgtaccaaaatattactgataatagcagtttgttgatattcatgcacaagctcttgtgtaatacccaccgcacttgctacgttggattgagtaccgtcagctcccaccaataaatgagtgcttaaagtgcggtgatcttctaactgaatgtttacttgctcaacatttcgttcaagagaagaaatagaaacgggggaaaaataatctatattgctacaatcctgcatagctcgcatcattaccgctcccgcctgatttaattcaatgacagcgcccagagccgcaagacaaaattctttagcagaaaactctgcaataccgaaatgccctcggtctgacacatgaatatgtttgataggttcacaaagaggcgttaataattgccacagcgattgcttattcggcaataaaatctgattgaaacgccggcaacttcctgatgataaagcaatacagcgagcatcaaagccaccgtgatgatgctgatgaggaatttgtttttccagtacggctatttttattttaccctgtgtctgatagctgagtgccaatgctaaactcgcaccggtcataccaccaccgacaattacaacatcgtagcgcaagtgcatatttttacccctctttcttcacttaaattattgttgcatcagattttcaatatcctcaatttcttttggtacagcagaggttaaaattttattcccattttcagtaatcaaaatattgtcttcaatgcgaacgccaattcctttatattgttccggtacatttgcatccgtaccgatatataaaccgggttcaacagtcaacaccatgcccgcttctaaagtgcggtctcgttttttactatttcgatctccgttttgcacctcactgctgtagcttcctacatcatgcacatcaagtcccaaccaatgccctaatccgtgcatataaaattgacgataactttggttatcaattaaggtttgtacatcgccagttaaaattcccaaacgaactaaaccctccactttaattcttaccacttcatcatttgcctgttgaatactattgcctgccactaacaactcaatagcacgtttttgtgcttttaatacaatttcataaatttctcgttgtgcctgagtaaatttaccgttgacaggaaaagtacgagtaatatcgcctgcatacatagcaaattcacaacctgcgtcaataagcaacaaatcaccatcttttaaaatttgatcattttcgttgtaatgtaaaatacaagcgttttcgccaccggctacgatactgttatacgcaacatatctagcaccgaaacgattgaagtgatgtagtatttcactttcgatttcatattcaaagcgattagggcgggtttgttgcattgcgtgaatatgtgccaaagcagaaatttgtcctgcttgttgtaacaaagcaatttcatttgctgatttaaacaaacgcatttcgtccacaagaactgcccaatctaaaacttgtgcaaattgcacagtttttctattcagtatatcttgtaaaaactcagttccccaaggttgttgagctgaatggtaataaagtgcggtgatattttccctcagttgtaaaaactgtgtttcaaattcggcaatatcataagccaaatccacagacaacgttttcgttgcattttcaatccccaaacgtcttccgttccacgtttccattaagggatctttgggccgcaaaaataaaatactttgtgatttttctgcagttttgattaaaagtaaaatactatcaggttcattaaagcctgttaaataccaaaaataactgtcttgtcgaaaaggataatgacaatcctgattacggattttttcctgagaggaaaaaacgatggtaattgaattatcttttaattgtgctaatagtttcttacgacgaaaaacaaactcatcgttaggcatttttgccatataagcaagatccataaatactccttaatgcttaaaaaacacactgaattctagcataaaaaaacaagtcattcgattgattaaaaaacaaagctaatctatctataaacagcaggcaataagaaaacaacgcactttattaattaagcgagtttagctaaatacattgactaatgtaatacggttgtctttgtttccgataatggtccgaagtgattaaagaataaaaaggtaatcgttctcacatattcaataatttcttctaatgctttagataactcctcttgatcatctttttcatcatatccaagttgtccaatagcttgtaaatcatccagtgcttcgccgatttcgcctacctctttatttaaattaggctgatttagccctaatcctaataaaaaatggttggtccattccgacagagcatcagctcgatcaaaaacattgtcttcttccggtaaccaaagctcaaaattaaatttatcaatatcggataaagtgcggtcaattttctgataaatttgttccacttctttcaataaggaagtgggatacgcatgatcatcatttgtaaattgataaagaagatactgccaacgttgatctgtaataccaccgcaaattaaaccggtaagaaaaccatgcaattcagccaccgttaatgcaatatttgcttgtttcagttgttgattaaattccgaataaataagaggtttttctgacatttgatatttccttgaaaaataatatgccagtttatcactgtttaacttcagcaaccaagaaacaaagggatttttatgacgaaaattttttgctatggcataataaggacacttttagcttttattataaaataggaaaacacatgtcaaagctcattgaattatccgtatcagggcaagtactacgtttaaattgtcctccggaacaacacgatgctttgcgtcaagcagcacatttattagataatcgtgttatggaaatgagagagcgtaccggtattttacagatggaaaaaatcctctctatcgttgcattaaatttaagttttgaactgatgcaggaacaacaaaaaactcaaacaatcgaaaatgtcattaatcaaaagattgctcaactcgaaggatctttggagaatattttggctcaaaaaacaactttttaaacataaatctgtgatctaatcgtgataatttgaaaaatattctagccaataaaaataaattgcgttagtattgcactcaaagattacctgagatgtttgccggcggattaagtccctgagccgatactgaaaacttaatgaattggcgtcctgttgttggtgtgtatgcttgctagccatgcaagaaacctaaaaacaatattagccgattcccttgaaccgtagggttcaaggaccgaacatccgcagcggcatctcggggctattcttagttatccagccaatatattgtcccatgagtatttctaatcaacgtcaacaaatacgacaacttattcgagaaaaaagacaaaaactgaccgcacttgagcaagctcaagccgaacaaaatattgcacaaaaagccttggatgcgattgaaaagtttcgtgcggaacatattgccttgtatctttcttttgatggtgaaatttcaacgaaattactcattgaacaactttggcaacaagaaaaaaaagtttatttgcctgttttacacccattttctcccggaaatttattattcttagctttccaaaaagatacacctatgcactacaataaattcggtattttagaacctaagttgaatgtgcgaaatgtactgcctgtttcacatttagatttgatttttacgcctttagttgcttttgataaggatggaaacagattaggaatggggggaggattttatgatagaaccctacaaaattggcaaaaaaaatcttttgtccctgtcggattagctcatcaaattcaagaagtagaacgactccccattgaaagttgggatattcctttagcagagattttaaccggataatgaacgcttaaaacgtttacggcggcgatgaaaattcgccgaagcggtacttttttttattgcatgagtaataggcatcatatcaggcgttttttgtcttgtgcgacgatggtaattcaaaaaataatgaatggaattcaccaataaagcactagctaaaaatagaatgattaattcaccatataactgattaaaaatgtggtttattttacgctgacttgcttgtctatatttcatatcaagagtaatacgtaaaaaaccctcaataccattagatgaataaatcggttcaacaatttgctgaatattcggttgcgtagtattgttcgctttttgatttaagttcaatttatcatgcaaaccgacaaaattcgcactatgtgctaacaatttaccgttagcaccataaacagaagcatcaatcacaaattcttctttcgtaaagtcgttcagttttttggtcaaaaggtccgaattggggttatccgcaaaaagcatagcaaaaagattagcttgctgacgcactaataaattggataagtagttcatttgattaattgttgctaattgtgaccctaatttaaacttattaatcccaaataaaatcaaagatataatagttagacaaagcaaaataatgccgagcaacattccaatttttagtattttttcttttattaagctcaagttattttccctaaaaattattaaataggctagaataagaacaaagaaataatttacaggatcttttatgcaaactcaaaacctagcgacaattatctctcattatacgctatttccttccccaattttatcagaaaaacccactgtacttggagaagattacttcattctctatggtaaaaatttaaatttggacagtttattaacttttcaacaaaagtgcggtgaaaattttctgattttagattgttggaatcggttagattacactgttgccttattcaaaagcaattggcaatcgcagtacttaactgttgctcatcaactggaacttgatattgcattattaaattttgatgctcgtttaagtcaagcgggattattagttatggatatggattcgacaattattcaaatggaatgtattgatgaaatagccaaccttgctggtacaggaaaattagtagcctccattactgaacaggctatgcgtggagaacttgattttgaacaaagtttacgtcgtcgagtagaaacgcttaaaggagcacctgaacatattttacagcaagttcgtgatagtttacctttgatgtgcggtttaaccgagatgttggaagtgttacaaaaatatggttggaaaattgccattgtatcaggtggatttacttattttgccgatcatttaaaagaaaaattaaagctggattatgcgatttccaaccacttagcggttgagcatggttttctcactggaaaagtacaaggtgatattgttgatggagcatataaagcggaaacgttaaaatctttagctcaaaaatggaatatagatttaaaaaatacagtagcaattggtgatggtgcaaatgatttagccatgatgaaagtcgcaaatctaggttgtgcttttcatgccaagccaaaagttcaacaacaagcacaagttgtggtaaactttgctgacttaaccgcacttttatgtattttaagtgcaaatgatcggattacaaaaaattaaaattgaggagcatattatgccgtcatttgatattgtttcagaaattactctatatgaaatacgcaatgcagtagaaaatgcaaatcgtgtattaagtacacgttatgattttcgtggtgttgaagctacaattgagttaaatgaaaaagcagaaaccattaaagttacgactgaatcagatttccagttagagcaattaattgaaattctaattggtgcttgtgttaaacgtgatattcaacataattccttggatattccggctgatagcgagcatagcggtaaattgtatagcaaagaaattaagctaaaacagggtatcgaaacagacatggcaaagaaaatcatcaaattaatcaaagacgcaaaactaaaagttcaaacccaaattcaaggtgagcaagttcgtgtttcaggaaaatcaagagatgatctacaagcgactattcaattagtaaaaaatgcggaattaggtcaaccgttccaatttaacaatttcagagattaatttctatttttcctacagaaaccgccaacaatataattgcacatattattggcgtttttttgtattcaaattattacagtattcttaaacttcaatattagtgtaatttaaagctaataggtactgtaatttggcttggtagcccagcaggtttttgcccaatactgcgtgcactttgaaccgcacttaatgctgccttatccaaatcttctgaacctgaagatttggcaatacttatttgacttaagctcccatcggtaccaatagcaaaactaacagtaacaatcccttgttttcgcatcatttttgcacgttgtggataacgtttatggcgttcaatttcacgacgcaacgcacttttataagcagcaacttcatcagtactatttcctgttccaatcaaattcggattagatgttgttactccgcccaagcccatagcctgcgaatttactttatcgtcagaatcaatatctctatcacctttaggtaaatcttttggctgtttttgttttgtacgttccttaggtttcttcttcggtttttccttcggcttatctttcggtttctccggttcttttaattttttctctggctcaggtttaattgttggatctgcaactacctctgttactacaggatctggctcaggttcagctactggttctggcttagaatcatctacaaccatacccattaacatttccattgagatctcagtaccaatcaaatccgcactatatccatttgcactgtcatctggtttagtaaaccaaaaaaaaccgccaattaatgcactatgaaatacaagcgagaagaaaaaaccaaaccaagaatgatatttcttcattacttacttgccttttctttcatcgttacaatagcaacatttttaatttcgttttttgccataatatctgtcaaggttacgaaatcttggaaagtagatttagcatcgacttttaatgtcactttttgctctttgtcccaagtcgcaatttcttgctccagttcttctactgaaatgggcttatcattaaaaaaaatctccccttgctcagttactgtcaataattttgctagatcatcggacttgaaagcaacagtgctacttgctttgggtacattaacttgaattttcccttgagaaataaaagaagctgtaattagcacgatggcaagaagcaccaacataatgtcaataaagggaataatattaatttcatcaaattttttcacattactcaccaatattttgctgactgtttaaggctttccattttagacggttaacttcaactttacgtcctaaaccgttgtaaaataccatagaaggaatcgcaacgagaataccgactgcggttgcttttaaggcaagagataagttaagcatgatagcagcggcatcaatatcccctcctgagttacctaattcatagaatgttaataaaattccaattaccgtacctaataaaccgacataaggtgcattagaaccaattgttgagataatggtcaaatgacggtttaaatcaatatctaactcatgaatattcgtgtaactttccactttaattttggtcagatacataaaacgttcaacggaaaaccataacataataaaactcattacaccgagtaaacccaaaataatgtagtcaatataatgatgtaaaaaattgaaaaactgtgacattggataacattccttgctgataaaaattacaaataagttattgagaattaatttcaattagggtgaggattttaacaaattttattgagagatcaagctataatattaaaaagagactttttgagtaccgcactttttcatctgttttttattttagtgaaatttgacgttttttgttcatactatgataaagcaattagaagaaatgactaattgaaatactgaaagataagacactaataattgacatccccctgccttaaggccggtcggatgtcaatttctcaaaaattggctgatgactaattctacgcacaatgcgatgatttcattattctctgccatttgtattgctttttctagtttttcaaaggcttttygaaatgagagaatctatttaaatctttttttcgcttcagctatcgcttcagctacacgtagtggtgaaactccgccttttgcacaacgtttatccaaacaggattgtaaagataagatttcataaacatcctcctctatggcattactaaattgatggaattcctcaatacttaaatcttctaaacctttatgtactttaatagcataaactactgtttcacccacaatatgatgagaatcacggaaaggtacacctttggcaactaaatagtctgctaattctgttgagttagaatatccctttaatgccgcttcttttgttctttcaacgctaactttaatatcttctaacacaaaagtcgccatatctacacaatcttgccaagtatccaacgcatcaaaaattccttctttgtcttcttgcatatctttattataggcaagaggcaggcctttcactgtcatcaacataccggtcaaagcaccgacaactcttcccactttgcctcgaattaattcgcaagcatcgggatttttcttttggggcattaatgaagaaccggaggttactcgatccgacagctccacaaaatcagcctctccactattaaaaatgatcatatcttcagcgaaacgtgaaaggtgagccatacttaaagacgcagtggaaagaagttcaataatatgatcacgatcagatacactatccaaactatttctcgttgccatcgcaaaatccagatcttgtgcaagtaaatcacgatcaatggcatacgcagtaccggctaaagcaccactccccaaaggacaagtattcattcgttgataagcgtcttgtaaacgaccataatcacgatccaacatttccacataagccatacaccaatgagcaaatgtgattggttgagcacgttgcaaatgagtataccccggcattactacgtgttgattatgctctgctgtttccactaatttacgttgcaattcacgcacggaatgctgtaattcagtaacacgttgtttacaccacatcttaatatctaatgcaacttgatcattacggctacgcccagtatgtagttttttgcctaagttacctactttatcaatcagtttactttcaacccaactatgaatgtcttcagcatcatcttgtaaaatcttttgtggatttgaccgcacttcaattagtagttcactcaatgcgttttcaagaacttgctgctcttgctgagttaaaacatttacggtaaccaatgctttagaccaaccgattgaaccctcaatatcttgttcagctaaacgatagtcgaaacgcaatgagtcgttaaaatctttaaaacgtttatctgtcgcttgtataaaacgcccaccccaaagtgccataatcacatcctttttctgttattatttgtggataaatttagttctcattatctcacacaaagaaaagtgcggtcaatttaaccttcacaatcccttcttaatattaccgctgactgtcatattgatactaaacgactctactttttgacttgattttcgcttgtgttttcttattgccatccagtacgacatttttctgcttattcggttaaagttaagagttttgatttaaattatgcgttacattatttaaaattactggaatgtgtcatcacatttagatgtttgattcaagcaagaggacgttaatgtaatttatttagatcaatagtgcggtagaatttaagatattatttaataataaagggtgataggtttatcatgaaaaatttccgttggtatttaagttatagggcgggaagatttaaacattattggagaaatgtgcagtgtcaaatttatgtagaaacataaaggttttttttaaagtttttttgtatcgctttaaacaaaataaattaaatcaagcagcaggctatttaacttatagtactacgctggctcttgtgccattgattatggtgtttttttccgtttttgcggcgtttcccgtttttaatgaaataaccggcgagctgaaacaatttatttttactaattttgccccttcaaccggtgatgccgttggagaatatattgatcaatttgtcaataattccaaacaaatgagtgcggttggaattattagtttaattgttgttgctttaatgcttattcattctatcgaccgcactttaaactcaatttggcttgatactagtgtgcgtccggcaatattttcctttgcaatttattggctaattttgacgcttggtccgattgttattgcgacgagtatcggtattagtacttatgtgactaaatttgcaacctatacatttgaacaagattttggtttatccgtgggtataaaacttcttagtttgatgccgtttttcttgacatggtttatttttaccgtgttgtatatggtagttccaaacaaaaaagtgagtattatacattctgccgccggtgcattaattgcagcagttttctttacattgggtaagcaggcttttacttggtatattacaacttttccgtcttatcagttaatttatggagcaatggcaacgttgccaattatgttactttggattcaactcagttggacagcagttttattgggagctcaactttccgcagtactggcggatatacgttcacttgattgtggtaatattcaaatagaaaaaattaaggaagaaaaatgattgcattaattcagcgtgttagccatgctaaagtggaagtcggacaaaatattgttgggcaaattggacagggattgttggttttactgggtgttgaaaaagacgatgatcgaaataaagcggataagttggctgaaaaggtgttaaattatcgcattttcaccgatgaaaacggcaagatgaacttaaatttacagcaaatcggcggagaaatattaattgtttcgcaatttacgcttgctgcagatacgcaaaaagggttgagaccgagtttttccaaaggtgctgatcctgagttggctgagaaactttaccaatatttcagtcaaaagtgtgcggagagagtgcgggtcgcaaacggacaatttgcagccgacatgcaagtgagtttaactaatgatggacctgtaactttttggttaaatgtataatataaaaataccgagtgttatgctcggtatttttatttctatttgaattaaaggaatttttcttttaattcttttgcgacagcaagttgtttttcagtcgcttttgctgtcataggttcacggcagtaacctgcattaacaccttgaagtttaaggatttctttaatagttaaatataaaccgttagccagtataccttcgattaagtcatttgtaacatgttgaatctcaagtgcttcagcaacttttcccgcttttgccaattcaaatatttgtcttgcacgtacaccatttacattaaatgtactaccaattgcaccatcaacacctaaagagactgctggcaacatcatttcatcaaatcctgcccaaaccagatggtttggataggcttttttcaagcgttccaataggtagaaatcaccggcggtaaatttaactcctaatactttgggattggcatagagttcaccgaattgctcaacgcccatattgacacctgttaagaatggaattgagtaaacgatcatattgttgccggtttcagcaataatcgtttcgtaataatgtttgatttcggcaaagctgaatttgtagtagaacggcgtgacggcggataagctgtcgtagcctaattctgttgcatatttacctaactcaacagcctcgtgtaagtttacactaccgacttgagcgattaatgcaacttgatcttttgcttcctctttggcaatacggaaaatttcttttttttctgcagttgagagcataaagttttcgccggtactacctccgacatataaaccgtcaattttcattttatcaatgttataacgaacgatctcacgtaaacctttttcatttatggaaccgtcttcgttaaaagacactaataatgcactaaaaataccttttaagtttttcatttgtttctcctgatataaaagggattaaaattttatttaatacgttgttctaaaatcacattaactgttttttgtttagtttgtaccgcactttcttcttccgcttgaacaatcaaggtgtaaattaagtccaatacaaaaagttgagctatttttgtaccgatagaatcgccttgtagctgcccttgtcgattaccgttgattaatacataatcagaaaccatagtgataggggagcgtaaattatgtgtaagagcgacggtaacagcaccgtttttcttggcaatattcaatgcttgaacggtttctttggaatagcctgaatgacttataccgataacaatatcacttgagttcattaatgcggcttgcatatacataaaatgattattgcttgttgcatcaacgtgtaatccaatacgcattaatttattttttgcttcttctgcagttaagcctgatgaaccgataccaaacaggaagattcgttttgatacacgcattaattcaacaactttttcgagttgagcaaaatccagcaaattaacggtttctgaaatgacattatgaatgacattttgcaatttttctgcgatttggcttgttccatcaaattttgatatatccgtttccagtagagaattagattgtcgatcttttgtagccaactcaatcgaaagttgtaatttgaaatcagtaaagcctttaaaacctaatgttcggcaaaaacgaataaaggttgcttctccgacatcgaattgttgtgcaatttccgctaaagagttttgtcccaacaactctggagaagatagaaccgttgtggcaatccgtttctctgtttttgttaggctatcatacaaagcaccaatggtatccaatatattaccgctcgttgccgccataattgagcctcctgttagcgttgtttgtttcttaatcgattaatgatatcggtattttaactaccaatttttttaagtgggtaacttgaccatgaacattacagcaaggtttgtgcggctcataaggaaaaaatatcgcaaacattttcggacgtaatgttaccgcacttttatgcggaatatcatcaattaactgataatcgtcttgctcattataagcagtacagtctgctaaattcggatattcaacaccatattcaattgtttccgcaccggaaattaatacttgaatatcaatatattgatgatgcaattctgcttttttatcttcagaagccacagtcgttgactccatgacattcatataaatttgatcggttaaatcatgtcgacctgtggtcaaattttctaaatctaatgtattaagacgattgcaaatatcgaccattacttgtggtaagttacgcttaaaatcatctcttgttaaatcaccaaaaatcattttttactcctattattatggggtttgttgcattttcatccaataagccgcaccaattaaacctgcatcggcaccgtatttagccggtgccaaaatacagtgataaaattttggcatgtcggttaaatattcttgaacgagggataagtatccctcagctaatccaacgctaccgcctaaaacaaccttttgtacatctaaactaatcaccatatcagcaattaagttagcaatagcttttgctgaggatcgaacaagtgcggttgctttttcatcatttttacggaacaagttgaacacttctttcggattacaaggtttttcccacttattcgcctcacgttcaattgctcgccccgccgcaatcgcttcaacacaaccacgacgaccgcaaccacaaattggaccgtttggatctgccaaagtatgcccgatatgaccggctataccatttagcccagtggataattttccatcaagaataattcctccgccaacgccagttgataccgtgataaaaataaaatttcgtaccgcactttggtcttgatcttggtactctgcacaaacagcagcctgtacatcatttagcaagccaatcggtttatctgtatggagagcaatgcttttttgtaaggggaaatcaaccagcccaccgagatttttaggattaagtgcggttaaaataccgttgttgataatgcctgtcgatgcaactgcaaccgcatcaaactgtcccgcataactttgcataatttgcttgatggcgtgatgcaatgcgactgtaggatctgcttgtggcgtgctgatttgctgacggttagagagcttcttttcttcaacaacagcggttgcaatttttgtaccgccaatatcaattgctaagcaacgcatacttttttccttaggtttagtaggatttagctgatttaaccgaggtgacgaaccagcttacaatatgttctaagcgagtcaatgccgaaccaacagtaacacaatcagcaccaatttcaatggcggctttagccagttccggtgtgttgtaacgaccttccgccatcacataacaaccgacagcttttaaatctttgactaattgatagtccggttcttcgggaatattgccgccagtatagccggacattgtacttcctataatatcaaagcccagttgttgacaatataaaccttctttcagatttgagcagtccgccatggctaaacaccccaattcgtgaatttttttcaccgcacttttaatgtcaacaggacgtttgcgatcggtaccgtcaaccgcaataatatccgcacctgccgctgctaagtcttcaatatcttgtagaaacggcgtaatccgtacaggactgtcttccaagtctcgttttacaattgcaataattggtacattcacgrscggacgagttgcttttaagttatctacgccttcaatacgcaagcctgcggcaccaccaataatggaggcttgagccatcgctgcaacaatttccggtttatccataggaccgtcatctacgggctggcaagaagcgatcaatccaccttgaatagcggttaaaacttgtttatgtgataatgttgacatataaaactccaaactatgggaataactgaacgttattccttttctttataaatattgcgttaatttacgggttagtacctcgtaacctttcggattgaaatgtagaccgtcggtacataaagttaaatctaattttccgtctttacccacaaaatcctgccaagtatcaataaatgttaaacgttcaggacagttttctcgtaaatagtcatttaacgccataatggaagagttatctgttgtagcaatattatttatcggtgttgcttccaatagaaagaattcggattcaggggaaattttgactaaggcttgccaaatatcacagatccaatccaatactttggcgtgagaatactcaggctctttaacaatgtcattcacccctaagaaaataaagacttttttacctaaatagttaatcaattgaggtttaataataacatctaaatattgtctagcactgacacccgaaatacctaggttggcaacacgtttgcctcttagttgaatttctggtgaaatatcactccacatatcaaagagtgagtgtccaactaaggtaatatcagcttgcttttcaaattccgcttttttaacttgataacggttgaaaatatcttgatctgtcagcaattttcggtccttaatttaacaatattgattaatattggaacgaattatataaaaattgaattttctcgcaatgttatttggtgttttactccaaaatttatttaaatttgtgtgccacgtcacaattctgaaataaaactctataaatatattttaaaatgattttttgtttttagaatatactttcagcaacagtgcttttcccttcatatttttaataggagaacttacgatgaaatttgaaaaactcgctcttgcaactttagcgttgagtatgtctgcctctgtttttgcagcagattatgagctgaaattcggtatggttgcaggtaccagttccaatgagtacaaagcggttgaattttttgcgaaagaagtaaaagaaaagtccggcggtaaaattgaaattgcaattttcccaagtgcacaacttggtgatgaccgtacaatgttaaaacaacttaaagacggttctttagattttacattaggtgaaactgcccgttttcaaatcttcttccctgaagcggaagtgttcgcattgccttatatgcttccaaactttgaaatcagtaaaaaagcattacttgaaaccaacttcggtaaggggttaatccaaaaaattaataaagagttaaatcttgagttattgtctgtagcttacaacggtactcgccaaactacatctaatcgtgcaatcaacagcattgcagatatgaaaggcttaaaattacgtgtaccgaatgcggcaactaatttagcttttgcaaaatatgtaggtgcttctccgacaccaatggcattctcggaagtgtatttggcgttacaaaccaatgctgtagacggtcaggaaaacccattaccaactgtccaagcacaaaaattctatgaagtgcaaaaatatttagctttaactaaccatatcttaaacgatcagctttacttggcaagtcgtgaaactttagaggatttaccggaagatttgcaaaaagtagttaaagaggcagctgagaacgcagcagagtatcacactaaattgttcaaagagggtgaaaaaaatttagttgcgtttttcaaagagaaaggtgttactgtaactactccggatgtaaaaccgttccgtgatgcgttaaaaccttactatgatgaatacttaaataaaaatggtgcgttagggaaacaggcaatcgaagaaatttcaactctcattaaaaaataaaaaatgccctttccctagtgagggaaagggatagcttttttgttcggagtatgtatgaaaataatgaacaagttagaagaatggattggcggggcattattcctcgcaattttcctgattttgattgcacaaattgttgcacgtcaagttattcatatgccacttatatggtcggaagaattagcacgtttgctgtttgtttatacggcattattggggatcagtatggcggtacgtgcacaacaacacgtctatattgactttattaccaatttaatgccgctgacaatcaaacgtatggcgatgacctttgttcaattattaatttttgtctcaattattctgtttatctacttaggctatggcgtttgggctgatgcaactttccctatggaagcattaaaagctacctttggaacggaaattacgcaaaaatggctctacgcagggttgccgattattgcatctttgatgttattccgttttttagaagctcaagcagaaaactttagaaacaaagccacttacttgcctatttcttttttccttgtaagtgcggtcattatttttgcgattttatattttcagccggagtggtttaaatctctgcgtatttccaactatataaaattcggtaaaaatgccgtttatatcgctttagcggtttggttagtgattatgttcttaggcacgcctgtaggatggtcattatttattgccgctttactttatttttcaatgacacgttggaatatcacttattccgcatcgggtaaattagttgatagcttagacagcttcccgttattgtccgtaccgttttttatcttaaccggtattttgatgaataccggtggtatcactgagcgtatctttcattttgcaaaaacgttattaggacactataccggtggtatgggacatgtaaatatcggtgccagcttaattttttcgggtatgtcaggatctgctttagcagatgctggcggtttaggtcaattggaaatcaaagcgatgcgtgatgcaggctatgatgacgatatttgcggtggtattactgctgcctcctgtatcatcggtccgttagttccgccaagtattgcaatgataatctatggtgttattgctaatgaatccatcgcaaagctatttgtagcaggttttgtacctggcgtgttggttaccatcgcattgatggtcatgaactactatgtttctaaaaaacgtggttaccctaaaacaccaaaggcgagcaaagcagaagtttgtgctgcatttaaagacacattttgggcaattttgacaccgtttttgattattggtggtattttctccggtttatttacaccgacagaagcggcggtcgttgctgctgcatattccgtaattgtaggaaagtttgtttataatgatttgaatctaaagaatttcctcaaaagctgtgtagaagcggtatctattaccggtgtaaccgcattaatggtaatgacagtcactttcttcggtgacatgattgcccgtgaacaggttgcgatgaaaattgcggaaatttttgttgctgttgcagattcgcctatcacagtgttaattatgatcaatttgcttctcttattcttaggaatgttcattgacgccttggcactacaatttttagtgttgccaatgttgattccaattgcgatgcaatttggtattgatcttgtcttttttggggttatgactacattaaatatgatgattggtattttaacccctccaatgggaatggcgttatttgtcgttgctcgggtgggtaatatgcctgtaagtgtggtagcaaaaggcgttttacctttcttgataccaatttttatgaccttagtattgattacgattttcccacaaatcattacatttatacctaacttgctaatgctttagcagtaaaactggggattgaaaagatagaagtcggtttatgatcgacttctgaagaaatctatttttcaatgtatatctggataggtatttatttttactcaacttaaataagcaattaagcaataatgttctatattatcattcgataaattaatttatcttaataaaagattaccaatcaatacaaaactcctgtacaatatctcagctttatttttccgcttagcgtgcggctaacgaaaataattttagtaaaagtaaagagcggtggtttttaagattatttttgctagtcgcaaattggaaaatagagcaataagattaacttactaatttataaggaaaatattgtgaatccaattgtaaaacaatttaaatatggtcagcacactgtaacattggaaacaggtgcgattgctcgtcaagctacagctgctgtcatggcgagtatggatgatacctctgtttttgtaaccgttgttgctaaaaaagatgtgaaagaaggtcaagactttttcccgttaaccgttaattatcaagagcgtacttatgctgcaggtcgtattcctggtggtttttttaagcgagaaggtcgtccatccgaaggtgaaacattaattgctcgtttaatcgatcgtccaattcgtccgctctttccggagggatttttcaatgaaattcaaatcattgctacggtagtttctgttaatccgcaaattagtccggatttagtggcaatgattggtgcatcagcagctctttcattgtcaggtgtgccatttaacggtcctatcggtgcggctcgagttggttttattaatgagcaatttgtgttaaatccaaccatgaatgagcaaaagcaaagtcgtttggatcttgtcgttgctggtactgacaaagctgtattgatggttgaatccgaagcggacattttaactgaagagcaaatgttggcggcagttgtttttggtcatcagcaacaacaaattgttattgaggcaattaaagagtttgccgccgaagcaggtaaacctcgttgggattggactgcactggaagcaaacaccatattgattgaaaaagtaaaatctattgctgagaatcgtttaggtgatgcttatcgtattactgaaaaacaagctcgttatgaacaaattgatttgattaaagcggatgtaattacgcaagttacggcagaagatgaaacaattagcgaaggaaaaattattgatattttcaccgcacttgaaagtcagatcgtacgtggtcgcattttaagtggtgagcctcgaatcgacggtcgtacagtggatactgtacgtgcattggatatttgtaccggcgtgttacctcgcacccatggttctgcgatttttactcgaggtgaaactcaagcgttagccgtagcgacacttggtactgagcgtgatgcacaaattattgatgaattaaccggtgaaaagactgatcacttcttattccattataatttccctccatattctgtgggcgaaacagggatgattggttcgccaaaacgtcgtgaaattggacatggtcgtcttgctaaacgtggtgttgcggcagtgatgcctagcttgtctgaattcccttatgtagtacgtgttgtttctgaaattactgaatctaacggttcttcttcaatggcatcggtatgtggagcctctcttgcattaatggatgcgggcgtaccgattaaagcggcggttgcaggtattgcaatgggattggtgaaagaagaagataattttgtcgtactgtccgatattttaggcgatgaagatcatttaggtgatatggactttaaagttgcaggaactcgtgaaggtgtaaccgcacttcaaatggatattaaaattgaaggcattactgcagaaattatgcaaatagctttgaaccaagctaaaagtgcacgtatgcacattttaggcgtaatggagcaagcaatcccagcaccaagagcagatatttctgattttgcaccacgcatttatacaatgaaaattgatccgaagaaaatcaaagatgtaatcggtaagggcggtgcgacagttcgttctttgactgaagagacaggtacatctattgatattgatgacgacggtacagtaaaaattgccgctgtagataaaaacgccgttcaggaggtgatgtctcgcattgaagatattacagcagaagttgaggcgggcgttgtttataaaggtaaagtaactcgtcttgcggactttggtgcctttgttgctttagtaggtaacaaagaaggtctggtgcatatttctcaaattgcggaagagcgtgttgagaaagtgagcgattatcttacaattggtcaagaagtaatagttaaagttttggaaattgatcgtcaaggtcgcatccgtttaactatgaaagagttggcgaaagaccaaactaagaatgaagaaaatcttctgcaatcggaagagggttctccggttcaagagtaaatttgatagagtaacttgaagggcaaattatatttgccctgtactgtatctgattactttcatcaatatagtgttttaaatgtgctatccattgaaatttaatcaataatctttttgtttatcttcattgttatttgaacaatattgaaattttgaatgaagccatttatccagcaaaacaagactcaatataagcaagcaaataaagcttgttgtttttaattaggcatatatttccgttgggtatcgttttgccgaacttgtaaaattgattgacaagtaaataatccatgatgaatgaactcaaacatggattccgtgttgtgaaacgagctttacaacgattaattaacctaaggcaaaagcatattgagctttcctttttacattcgagtatttttaatgactgaaacaacaattacttttaatgatttagggttacctgaattcatccttaatgcagtgtccgaaatgggcttttcaactccttccccaattcaacaggcttgtatcccgcatctattaaatgggcatgatgtgcttggcatggcacaaaccggtagtggaaaaacagcggcattttctttgccattattggcgaaaattgatactaatgaaaaatatccacaaatgttagtaatggcaccaacccgtgagttggctattcaagttgctgatgcttgtgaacagtttgtgaagttttctaaggggatgcgtattgttactctgtacggcggacaacgttacgatattcaattaagagctttaaaacaaggtgctcaagtggtcgtcggaacaccggggcgtattttagatcatattcgtcgtggtacattggatctgtcaaatttacagtctattgtattagatgaagcggatgaaatgctacgcatgggatttattgatgatgttgaaaccgtcatggcggagcttccagagcaacaccagaccgcacttttctctgcaacgatgcctgctccaattaaacgaattacaaaacgctttatgcacagtccgcaagaagtaaaaattcagtcaacacaacgtactgcaccggatattacgcaaagctgttggtatgttcgcggttttcgtaaaaatgaagcattgttgcgtttcttagaagtggaagattttgatgctgcaattatttttactcgaactaaaacagctacattagatgtcactgaattattggaaaaacacgggtttcgtgcagctgcattaaatggagacatgacacagcaattacgtgagcaaacattagatcgtcttcgcaatggaagtcttgatattttagtggcgactgatgttgcggctcgtggtttagatgttgaacgtattagtttagttgttaattatgatattccgctggatgcggaaagttatgttcaccgtattgggcgtacaggccgagcaggtcgtgcgggccgtgcgattttgtttgttgagcctaaagagcgtcgtttattggggaatattgaacgcttaatgaaaaaagcaattgaagaagtggaaatgcctaatcatcttgctttacaagaatgtcgccgtaaaaacttcgtggctaaaatcactaagcaattagaacatcatgatctagaacaatatcgtagcttattggaagatttatttacggcagatcaggatcaggaagacattgccgcagctatgttgatgttattacaaggcaaacaaaaacttattcttcctgaagatccggtgtttgaaaaacattcacgacgtaatgatcgtagagagagaggggagcgtcgaggtaaagaaaatccacgttctgagcgtcatgggtatggtattccgcaaccaatggatttatatcgtattgaagtcggtagatgtgatggtgtcgaggttcgtcatattgtaggtgcaattgcaaatgaaggggatattcaaagtcgttatattggacatattaaactttatgacacttattcaacgattgaattgccacagggcatgccaaaagaattgttacaagtatttgctaaaacgcgtgtattaaataaacagatgcgtatgtctttcgtaagtgcggtcaattctgaggaagagtttgaagccggctcaggtggtaaacgaaaagggcgttatgaacgtgagtttcgtggtggacgtaaatttaatgaaaaaagtaaccgctctttttctgaacagcgtaaagaacgtagagaaagaaagagataaaagcaaaggggctattacagccccttctttctgataaagcaaataattaataaaaattttattaacgactgcggaaaataatacgacctttactcaaatcataaggtgtcatttcaaccgttactttatctcctgttaaaatacgaatatagtttttacgcatctttcctgaaatatgtgcagttacgacatgaccgttttctaattccacacgaaacatcgtatttggcaaggtttctaaaattgttccctgcatttcaatgcaatcttctttagccatttattcctctaaatatgaatgaaaaaataaaaacttcgggattatactctattaatgagaaagacgaaaagaatttattctattaaagggatattatttttatttagttaatattgaaaaatttatcggattgaaaaattgtatttactgactaaaaagattagtatttgactgaagttatactatattttttattaaaaaggataatctatggcaagaattgcaattattcccgctagggcaggttccaaaggtattaaggacaaaaatctccaattggtaggcggtatttcattggtcggtagagctattttagcggcacaagaatctggtgtgtttgatcaaattgttgttaattctgatggtgagaatattctcaatgaggctgaaaggtatggtgcgaaaacatttttacgtccttctgagctggcacaaagtgatacgagaacgatagatgttattttacattatttgaatgaattaaagattgaaaaaggaagtgttactcatcttcaacctacctctcctttaagaagcggaatagatattaggaatgcaatggaaattttttcaggagggtgtaaatcagttatatcagcttgtgaatgtgaacatcatccttataaatctttcattatggaaaataatgagattattccacatagagaaatcagtgattttgaagcacctcgtcagcaattacctaaagcatatcgagcaaatggcgctatctatattaatgatattgaagcactattaaagaacaaatatttttttattcctccaataaaattctattttatgccaactcattgctctgttgatattgacaatacgctggatctgcaaattgcagaaaaattaattcaaaatcaatattagaggttatatttttaaggataaaaatcagcgagatgtgtcgattattcgctatgctaaaattgtgctgtgttagcaattttcaaactttgatttatatttggaagacatgaacattctcattacagggggagccggatttatcggctctgcacttattcgttatctactgactgaaactgaacatactatcattaatgtggataaattaacctatgcagccaaccttgatagcttacaaagtgcggtgctcaatccacgttatttttttgagcaagctgatattgttgatcaacctgtgataactcaaatatttgagcaatatcagcctgatgcagtaattcatttggcggcagaaagtcatgtagatcgctcaattgcagcaagtactgaatttattcaaaccaatattgtagggacatttgctttgcttgaggttactcgtcattattggcttaaattgcctgcaaataaaaaagagcggttcgtttttcaacatatttctacggatgaagtttatggtgatttaattgactctgaacaggcttctactgaaagtagcccttatcaaccaagcagtccatattcggcttcgaaagcagcttcggatcatttagtaagagcatggtatcgtacctacggtttacctattctaattacgcattgtgctaataattatggacctttccaacattcggaaaaattaattccacgtatgattttaaatgcagtgcaagggaaacctttgcctatttatggagatggtttgcaaattcgggattggttatttgtagaagatcatgtacgggctttatataaagtattacaaaaaggaaaaatcggagagagttataatatcagtgcaaattgtgcaaaaaccaatctagaagtggtgcagacaatttgcgatttattagaacagttagtaccaaataaacctaaaggaataaagcaatatcatgagttgattattcatgtcgaggatcgtcttggtcatgataagcgttatgccattgatgcttacaaaatccaaacgtctttgggctggacacctttacaagattttaccgccggcctacgtaaaaccgttcaatggtatttgaacaatggaaattgaagaaatggttaagactgttagttaagcagagtagtgatacacacaacgacaggtttaatatttcgtatgcagtatgtaaaatagctaatcattaagaggtatatacaaggtttaaataaaaaacgttacataaaaattaaacaaaaaattaacaaaagtgtgatttttgtcatatttttgtaacattaggtttattttttcttctatttttgtttacaattcacatcgcatatatcgttgcaattatatcttataatttatttactggagtaagttttatggccctctttttgagtatctttcctatcgttttattaatttatttaatggtaaaacgtaacgcattaccttcttatttggcattaccttggattgccgctgttgtattaattattcagttagttttcttcggtacagatattaagattgtgagtgcaaatattgcatctgcacttgtagcagttcaaacacctatcactgttattttaggtgctattttattcaatcgtttctctgaagtatcaggtgcgacgaatatattacgtaaatggcttggtactattaacccaaatccggtggcacaattgatgatcatcggttgggcgtttgcttttatgattgaaggggctagtggttttggaacgccggcggcgattgccgcacctattcttgtcggtctaggtttccctgcgattaaagtagctgttttgacacttattatgaactctgtgcctgtatcattcggtgcggtaggtacaccaacttggtttggttttggtcctcttcatttgggcgacggtcaaattttggaaatcggtgctatgacagcattaattcacgctttcgctgcattggtgattcctttaattgccttaagtttcgttgtaagtgtcaaagaaattcgtcgaaatattatctatgtttatttaagtgtatttgcttgtgttattccatatattttattggcacaagtaaactatgaattcccgtcattagttggtggtgcaatagggttacttatttcaattctacttgctaataaaggtattggcttggctaaggttgaaaataatattgaagctgcggttccttttaatgacgtagtgaaagcattatttcctaccgcacttttaattgctattttgattatcactcgcctccaacagttaccgttcaaagcgatgatgaacgatgcgacaacttggtttgcagttcaattgggttcgttagggcgttttgaaatcagccatggtttaattttcagcctgaaagacatttttggtacatcaattaattccagctataaattattgtatgtgccggcactgattccatttgttgtaacagtattaattgctattccggtatttaaagtatcggcagcaaatacaaaagatattttcgttaccagcttccaacaaactaaaaatccattctttgcacttgtcggagcattgattatggtgaatttaatgttagtgggtggagatggttcaatggtgaaaattatcggtaagagtttcgctgctgcaacaggagagtattggactgtcttctctgcttatttaggtgctgtcggagcatttttctctggatccaatacagtatctaacctgacatttggtagtgttcagttatcaactgcagagttaaccggcttatcaacttcattaattcttgcgttacaatctgtcggtggtgcaatgggtaacatggtatgtattaataatattgttgcagtaaattcagtattgaatatccaaaaccaagaaggggcaattattaagaaaacagttattccaatggtaatatatggtattattgccgcactggttgcattgtttgttatcccgatttttttctaaataatgtatacttttggtaagcagtattctttgatgctgcttacttttatttattttaaattgaaatattggagttcttatgaatgtcaatttttatgtcacttgtattgctgatgtggtgaaggcaggcgtggcaaaaaatacagtattgttgttagagaaactaggttgcaagattatcttcttggaaaagcaaggatgttgtggtcagcctgcaatgaatagtggctatacaaagcaagcattggaaggaatgaagaatttagtatcaacttttgaggtaaatgattatccaattgttgcaccggcaggatcttgtgtttacgcaattaaaacttatcctgagcaattttctcgtttcggtgaaactgaatgggcagaaagagctcaaaaggttgctgatcggtttcatgatcttactgattttattgtaaataaattaaaagtaactaatgttggtgcaaaattaacaggtaaggctgtttatcatccatcttgtagcttatctcgtaaattgggtattgtgaatgaacctttaacacttttacaaaatgtaaaaggattggagcttttacctattactaaccagcaaacttgctgcggattcggtggtacattttcggtaaaaatggcagaaatctccggagaaatggtcactgaaaaagttgagcatattacagaagttgaacctgagtatttaattggtgctgatgtgagttgcttaattaatattggtggaagattgaaccgagaaggcaaaaagattaaagtcatgcacattgctgaagtattaatgcaggaggataaataagatgtcactaaaaaccagtaatcttgcatttaaacagcgtgtggacaatcaaatccataatgaaatgatgcgtaaagcggtagttaaagctcaagaaactatcggtgctaaccgtcaaaaaatggttgatgaattggggcattgggaagaatggcgtgatttagccaaacaaattcgtaatcatgttttagcaaatttagatgcttacttatatcaattgagcgagaaagttcagcaaaatggtggaaaagtttactttgctgaaaccgctgaagaggctactcaatatattcgtcaagttgcgttagaaaaaaatgctaaaacaattgttaaatcaaaatcaatggtaactgaagaaattggtttaaatgaagtgcttgaaaaggaaggcatgaaagtcgttgaaactgatttaggcgaatatttattacaaattgttggagataaaccttctcatattgttgtacctgctattcataaagatcgtcatagaattcgccaagaattacatgatgccttaggttataaaggaacggaacaaccggaagaaatgaatgcttttgtgcgtaaaacattgcgtaaagatttccttgaagctgatattggtatttccggttgtaattttgctgttgctgaaacaggctcggtatgtttggttactaatgaaggaaatctgcgtttagctacaacagtaccgaaaacccatattgcagtaatgggtatggagcgtttagcaccaaccttccaagaagtagatgtattaatcaccatgcttgctcgtagtgcggtaggtgcaaaattaacggcttataatacatggttgacaggtcctcgtcttgaaggcgaaaccgatggtccagaagattttcatttggttattgtggacaatggtcgttcatctattttggaaagtgaatttaaggaagtattacgttgtattcgttgtggtgcttgcttaaacacttgtcctgcatatcgtcaaattgggggacatggttatggttctatttatccgggtccaattggatcggtaatatctcctttattgggaggttatgaagaatttaaagaattaccttatgcttgttctctttgtactgcctgtaactcagtttgtccggttaaaattccattggcacaactcatctcaaaacatcgtgaacacattgcacaagctggtatgacaccaatgttagaacggttgtctatttttggctttactttagcaaactcaaatccgacgttatggaaaataggtgtaaaaattggtgctaaagtggcggctaaagtgattaaaaacggtaaagcaccaattgaggttggagcgttggcagagtggactaaagctcgtgatttaccaacaccagatggcgagagtttccgtcaatggttccaaaatagaggtaaaaattaatggatttacaaaatcgtgataactttttaaataaattagctaccaaaatgggcagacctcgtcaattcattcctgagcctatgcctgagttggtcaataattatccgacaacgcgtttaactgagttgagcaaaaccgacttagttgatgagtttgtgcgttttgctaaagtgatgatggcggatgttattgaaacaagtgaagctgaactaaaccgcactttactggaagtttgcgagaaatatggtggcggtagtgttattttaaataatgacaaaagattagctgatttgggtattttgcaatctgtccaagaaaaatacgatagttatatttgggatttaaatcaaacggaagaaaattttgcccaagcggagaaagctaatattggtattgtgtatggtgagtatgggttggcagaatccggtggcattgttttattttcggataaagattttggccgttcagtgagtttattaccggaaaaatccattgtggttttacgtaaaagcaccgttttaccacgagttgcacaattggctaagattttacatgaaaaggcacaacgaggagaaaggatgccttcttgtataaatattatttcgggaccgagtgctacagcagatattgagttaattaaagtcgttggtgtacatggaccggtacataaaatttatattgttattgatgacttataattgataattaaatcgttaaaaaaatgaccgcacttcaacataagtgcggtcatttcttatttgatttataggttatggcaacacattacttttaagccattgttcaaattcattattgttcataaaacctgttatacgagcttgttctatttcctttcctgattgatcaaagaaaatgatagtcggcaatcctaaaacagtcagttgcttcatgagttcagtattgtccggactgtttttggtcatatttacttgtaacagtaagatatgctcaaataaaggctgtacatttgaagcactgaacgtatatttttcaaactctttgcaggcaacgcaccaatcagcataaagatccaacatggcaaccgattttggattattagcaagaacgtgttgcaattctgcataattttgaatgcgttggaattgagaatgagaggggtgttgttgaactgcgttttgttcgtgattccaatttgaattgagcaagaatagtgcggtaaaaacaaaggcgataatccaacctaaccagttttttcttaattgaataaaaaaccagacaatgaaagcaaacaaccagcttgcccataaataatcactatattcaggtaaaacacgagaaagtaggaaaataggtaacagtaacatgacgaaaccgaaagcagctttgaccttttccatccaaacacctgactttggtagaattttgttgccaaataaagtaattaacatcagaggaatgcccatgcctagggccaataaatagagtgtaaatgcacccgttgtgagatcgccggtttgagctacataaagtaatgctcctgataatggcgcggaagtacagggagaggcaacaagacctgcaatcattcccatcacaaaaacaccgccaaaagcaccgctcttttgttgttggctgagtaaggtgagtttagtttgtagcgagcttggcagttgtagagtaaagactccaaacatggataatgctaatagaataaaaataacggataggctgaccagtacgtaaggactttgcagtgctatttgaaatggtaatccgattgccgctacaattaatcccaataatgtataggtgagtgccataccttgtacataagcaaagcttaaccccaatgctcgtaaactattcggtctttgatttgcaccgataataatcgctgacaataagggaagcataggtaagacgcaaggagtaaatgcaagccctaagcctaacaagaaaaaacctaatggtgcgtatttgttatttaataagtttgcagcaagttgattttgttcagggtgttgcatggcagtttttcccgcaacacttaacagatctttgttaatagagatttcttgagtttcaggcggataacaaagtcctttggtacaaccttgataggtaatgagtgctttattaaaagaactatccgttggaagattgatggatagatctaattgatggcgataaatctcagtttctccaaaaaattcatcttgatgtagctcagcggtagggaaatgaagattctcaatagaaacacgttgatttttgttatcatcattcactaattcaatgctgatttcttttttatacagataatagttttcagcgatagcccaatgaagatcaagtttttttccttcttgttgactactgaattgaaatgcttcatggctttttaaaaattgtgtttttttaccaaaaatgtttccttgtgtttgagatgcaaaaaaaagtgcggtgaaaaaaatataaaaaatagttaaaatttttttcattcaaatgatccctttctaaatagttcaatcgttcaatttatgcagggcgacataatatctgtggcatcagattaaagcaagcgttttatgatctacgtcatgaaatctagctgtatggaaaaaattatctcttttcacttgttacgataatgttgcaattatacaataagccccgaactgaattggattatattctaggaataaagtatgaacataccgcaaattttgattgttgaagatgaagtgattactagaaatatgttaaaaagtatctttgaggctgaaggctataatacactggaggcggctgatggtaatcaaatgcatcgtatacttgctacatgtgaaattaacttagttattatggatattaatttaccggggaaaaatggtttaatgttggcacgtgaattgcgtgaaaatacaaatacagcattaatgtttttaaccggtcgagataatgaagtagataagattttaggtttggaaatcggtgcggatgattatattactaaaccgtttaatccccgagaattgactattcgtgcaagaaatcttttacagcgtacgatgcaagaaatacctaaatctggcaccagtcaggtagaacagtatagattcaatggttggacattagatttaaattcacgttctttaattaatcctgacggagaagaatataaattacctcgtagcgaatttcgagcaatgttgcatttttgtgaaaacccaaggaaaattcaaactcgtgaagagctattgagaaaaatgacgggaagggaattaaaaccacaagatcgtacagtagatgtaacaattcgtcgtattcgaaaacattttgaagatcatgcagatactccggaaattattactactgttcatggtgaaggttatcgtttctgtggtgaattagaagaaaactaattaatttgaatagggtaaaaagtgtcatccttttggtattttttgtattggtttgcacattgccctttttctaaaaatgaattgaaaatagatctcactactttcaatactttttctagtctaatattttgataagaaaagcatttttaagtaayggaaatctcttaaaaataataagtcaaagagttttattttttatttctcgtaagacttgtaaaatatttttcattgcgagatctaatggagcaactaggcgtagcctttcccctgttttaggatgttcaaaacaaatagcaaaagcatgcaagaataaacggtttaagccaagtgcggtcatttgttgattaaaatttttatcaccatatttatcatcaagtgcgataggatgacctgcgtattgggtatgtacacgaatttgatgagttcttcctgtaataggagatgccttaactaaagtagcattattataacgttcttcaatgctaaactttgtttctgaaggcttaccttgttcacttacttttacaattcgttcgccactcgtaagttcatttttcaacaatggtgcttgtatcatcttacaatgagattgccaatgaccacgaactaatgccagatattctttttgtatggttttttcacgtagttgctcatgtaggctacgtaaagcagatcgtttctttgcaataagcaatatacctgaagtatctctgtccaagcggtgtactaattctaaaaaacgtgcttcagggcgtaatgtacgtaatgcttctattgctccaaaatttaatccgctaccgccatgtactgcaaggcctgaaggcttgtttaacaccaataaataattgtcttcaaagataatttgttgttccaactgtgcgactttattcaatttttttgaaataggggtatgttctttttccgcaatacgaaccggtggaattctaacaatatcgccattttgtagtttatactcaggtttaattctgcctttgttgacccttacttcacctttacgcaaaattcgataaatcaaacttttgggtacgcttttcaattttgccaacaaaaaattatcaatacgctgtccactttcatcttcattgattgttagtatttttacactttggtttatgattttttcattaatatgtgtcatttttaaattttttcagcttatcaaattgttatgtatcatagcataaaaataggaattaccttgctaaaatttatttatcagtagataatagagcctatttttgggtaggtaaaatactcaaaactaaataagtcatcattgatcattttttaatgctgcgaatggcgtaagacattaatatatgaagtgatttcttggtagattaaagtaaacgacagcttgcaaaattaaacatttcaataattttgtttgtattaagaaagctattttaacacccgtcttaataacgcattcaatgcatccggcaactgacagtcgagagacaggcattttgtgacagataagaggtagattgcgaagcaaagagcggttattttaatgctaattttgataataaaatttagagaaaatttagacaatgaaaagaatgttgattaatgcaactcaaaaagaggagttgcgtgttgctttagttgatgggcaacgtttatttgatttggatattgaaaatcctggacatgaacaaaaaaaagcaaatatttacaaaggtcgtattactcgtgttgaaccgagtttggaagccgcatttgttgattatggtgtagaaagacatggttttttacctttaaaagaaattgcacgggagtattttccggatgattacgtttatcaaggtcgtccgaatattcgagatattttatctgaggggcaagaagttattgttcaggtcaataaagaagaacgcggtaacaaaggagctgccttaacaacctttgtgtctttggctggaagttatttagtcattatgcctaataatcctcgtgcaggtggaatttcacgtcgtattgaaggggatgaacgtttagaattaaaagaggcattaagctctttggacgtgcctgaaggcgttggcttaattgttcgtactgccggtgtcggtaaatcacctgaagaattacagtgggatttaaaagtcttgttacatcactgggaagcgattaaacaagcctctcaaagtcgtcctgccccctttttaattcatcaagaaagtgatgtgattgttcgtgctattcgtgattatttacgccgtgatattggcgaaatattaattgatagcccgaaagtgtatgagaaagcgaaagcacatattaaattagtgcgtcccgattttattaaccgagttaaactttatcaaggtgaagttcctctgtttagccattatcaaattgaatcacaaattgaatctgcgttccagcgggaagtaagattgccttccggcggttccattgttattgatgctacagaggcattaaccgcaattgatattaactcggctcgttctacacgggggggtgatattgaggaaacggctttaaatacaaatttagaagcggtggatgagattgctcgtcaattacgtttacgtgatttaggcgggttaattgttattgattttattgatatgacaccggtacgtcatcaacgtgaagttgaaaatcgtatgcgagaagctgttcgtcaggatcgtgctagaattcaaattagccgtatttcacgttttggcttactggaaatgtcacgtcagcgtttaagtccttcattgggtgaatcaagtcatcatgtttgccctcgttgtcagggaacgggaaaaatacgtgataatgaatctttatcattgtctattttacgtttacttgaggaagaggcattaaaagaaaataccaaacaagttcatactattgttcctgttcaaattgcttcttatttattgaatgaaaaacggaaagcgatccatagtattgagaaacgtcataatgttgatattgtggtagctccgaatgaagccatggaaaccccgcactttagcgtttttcgtgttcgtgaaggtgaggaaataaatgagttaagttataacttagctaagttgcatgaaatgaatgatgagacttatgttgttgaggacgcttttatttctcgtcaccttgaaaattcagcagcaacagtggaaagtgcagtcgagaatgcggcggtttcattagctattgaaactccggcaccaatgccacaagaaagaaaacaagagagagaatccttattgagacgtattattgaggggattaaaaacttgtttgctgataattcaagtaaaaataaaaaaaacaaaaatactcgtcagaataaaaatgctcgtcataatcgtcgtaaccaagatcgtcgttctagccgtcgtattcgtcaagagcatgagattaaatctgatgaaaataataaattagatacacagcattctcattatactgaacgttattctaagcatgctaagaaaggcgttgatgatccgaaaattcagacaaagaaagcgggtgagttggaaattcatacaaaagatgatgagactattgaaacaattcagcctcgtcgccaacgtcgtgatttgcgtaagaaagttagagttgaggaaaatttagttgatacgccaaatttggtatcaactgaagaacacgttgaaaatgaaaaaacaacagagcctgttacaagtttagaacaagcggttttacagacagaaaatgagaaaactcatgaacgtcaagataataactatcgtcatcgacgcttacctcgtcatttaagagtgaataatcaaagacgtcgtcgtaatgtagagttgaaatctgcgattcctctatttgctgcggtagcatctccggagttagcgagtgggaaagtttgggttgatgttaatgtagttaattcaaaaaataacaattttttatctgtagatgaattactaaaacagcaatatcaacaagaggaaattgaagttgttattcctgctagtgaaatcttgatggatactcaatctgatgatattaagcctttaagtaactttgttagccaaccagcaaatgaagcagttgaaaagaaagttcaagaaaccttgcaacgtttaactcaagaggtggttgacgaatcatcaacaatcgaacgcacagaggtagatactaatatttctgtacctgagtttgtacgtgaatatcagtttaacggacgattggggacaatttctgcggttatgcatacgaaagcagaaatgacacttgccaagtcaagtgatgagccaatgcagcctttctcaatcgttgaatggcaagattctcgttattatttctatggtagaggagcggcaggacatcattgtgcaatcagccatgtttattctgaacctgctaatactaaaatagaataaatattttacatgaatgaaaattccacgcttgaatggaacatgaggaaatcatggacaatacaagcgtggatttttgtttttataaagtcataaaataggtataacaaagaaaaatctatagaataactttcttggttctgatggaaaatatcgtaaaacttctttttgttctttcgcaagtgagtatcggctcaaaacactctgtcataggtacattgtagtagagaagagtttgccatagtttagaaattttgaaaatgtttcaatacgttgcaggataggggttaaatggtcccccctaccggacttgaaccagtgaccaagcgattatgagtcgcctgctctaaccaactgagctaaagggggacaggtcgtggattatattgaataaaaataataaagtctataaaaaggagattaaaagcttaaaattcattcaatctcttgatttcaactattaatgtgcctcatcccaattatcacccacaccaatatccacaattaatgggactgataaatgtgccgcattttccattaaagacttaattaatgcagaatattcatctaccttattttctttcacttcaaataccaattcatcatgaacctgcatgatcatttgaatatcattttttttgatttcgttatgaatagcaatcatagctaatttaataatatctgccgcagtaccctgcattggtgcatttatcgccactcgttcagctcctttacggcgtattgcattagatgaattgatttcaggcaaatatagacggcgtccaaataatgtttctacatagccctgctcttttgctttttctcgaatatcaaccataaaagtttgcactcccggataacgttggaaatatagatccatatatttttgagcatttgcccgtgaaatgccaagttgattagataaaccaaaagaactcattccataaatcaagccaaagttaattgcttttgcacttcgacgttgttcacttgttacttcatttaatggaataccgaaaatctcagctgccgtagaacgatgaatatcttttccctcattaaatgccataatcaaaccattatcttgagataaatgtgccataattcgtaattcaatttgtgaatagtctgcggcaataattttataccccttacgtgcaataaaggcttggcgaatacaacgaccttcttcatttttaatcggaatattttgtaaattgggatcgctggaagataaacgtcccgttgctgttactgcttgatgataagatgtatgcactcgtccggtttttttgttcaccattgaaggcaatttatcagtgtaagtagattttaattttgctaatccacgatgttccatcaataatttaggcacaatatgtccctgttgagctagcgtttccaatacatcttcatttgttgaaggtgcaccttttggggtttttgcaatgataggtaaggctaatttagtaaagagaatttcttgtagttgtttggttgaagctaaattaaattctgctcccgcttcttgataaacttgttgctcaagtgcggtcaatcttctcgcaattttttcagattgctttaacaatgcctgactatcaattagtacaccattgcgttccatctttgataatacttttaccaaaggcaactcaatatcattaaataccttcactaaacttggcgattgttgtaattcttgccagaggacttgatgtaatttcattgtaatatccgcatcttcagcagcatattctgtcgcttgagcaatggcaattttatcaaacgttacttgtttttttcctttaccggcaatactttcaaattcaataacttgatgtcctaaatatcgttccgataaggcacccatattatgtcgtcctgtgctgtcaagcacataggattgtagcatcgtatcaaaacaaacaccgtttaattgaatatgatgattggcaaaaatagttaaatcatatttaatattttgtccaattttttgaatagacggattttctagcaacggctttaattgtgctagacacgtctctttatttaattgattttttacaagctcaaattgttcagcattttgttctgattcagtgaataaatctgtttgtgttatttcttttacagcttgtttatgagccagaggaatatagcaagcctcgccgttggtcagtgcaaaggaaataccgacaagattagcacgcataggatctaaagcatcggtttccgtatcaacagcaataagatctgcctgttgaagtttttccagccaactatttaatttctcttgagtatcaatagtttcatatgaagtgcggtcgattttaatcgtttttttgaccgcacctttcgactcagaggcactatttgtttgagttttatcaagtttaatttcttgctgagttgctttggtaagtgagctttcaccgcttatcacttcgtttagccaacgtttaaattcataacgagcaaagtattcaatcaattgatcttggttattttgccccaacacgagttgatccggtgtaatatctaactcaacgttggtttttattgttgctaaaaggtaagataaatccgcatctgccttggcggaggatagtttctccccgagtttttttgatcctctaactgataatccagccactttttctaaatttgcataaatttccgccatactcccaatgccttgcaacaatcccaatgctgttttttcaccgacaccgctaactcccggaatattatcggagctgtcgcccattagtgctaaataatcaacaattaattcaggcggaataccatatttgtctattacaccatctctatccagtaaactgttattcatggtattgatcaacataatattatcatcaaccaattgtgccatatctttgtcgccggtgctaattagaacattttttccctgttgagaggcctgaaccgctaatgtaccgattacatcatcagcctcgacaccttcaacagacaacagcggaattcctagtgctttgataatattgtgtaatggctgaatttgttgacgtaaatcatctggcatagggggacgatgggatttatattgttcaaatatttcatcacggaacgtttttccctttgcatcaaatacaaccgctatatgggtcggttgaacctgagcaattaaactttttagcatattcaatacgccatacattgcacctgtcggttcgccaagagaatttgttaatggaggaaaagcatagaatgcacgatataaataagaagaaccatctacaagaacaagcggattttcagcaattttagccataatagaataatctcaaataacacaaagagcggttattatagagcaaatttttgagggaggcgaatttgaaaccggaataaacaagactgaaaagaatatattttaagcaatgcaaaataaatccttagacttacgcaacttaaagcaatacaatttcccatcaattttgtcgatgtttttaaccgcacttttaaaccaaaagatcttatgaaactcaatgctcaacaacaacaagccgtagaatacacgcaaggtccttgcttagttttagccggtgccggctccggtaaaactcgggttattattaataaaattgcttatttaattgagcattgtggctacttaccaaaacaaattgctgctgtcacatttactaacaaagcggctagagaaatgaaagatcgtgttgcacattcaattggtaaagaaaaaacaagaggtctgcttgtttcaacttttcatactttaggttttgacattattaaacaagaatacaaacatctcggttttaaagccaatatgaccttatttgatgaatatgatcaaatggcattattaaaagagattacggcagatctattaaaagaagataaggagctattgcaagagacagtttcggcgatctctcgttggaaaaatgatcttattcttcctaaacaagcgttcactcaagtaagagacagcaagcaacaaacttttgccaagtgttatgagcgttacaataatcaaattcgtgcctacaatgtattagattttgacgatttaattatgttgcccactttattatttctccaaaatcaagaagtgcggtctaaatggcaagaaaaaattcgttatttattagttgatgaatatcaagacaccaatacaagtcaatatgaattggtgaagttattagtcggtcaacatactcactttactgtagttggtgatgatgatcagtctatttactcatggcgaggtgcacaaccgcaaaatatggctcggttaaaaaatgattttccacaattacaagttattaaactggaacaaaattatcgttctaaccagcgtattttgcattgtgccaacatcttaatcgcaaataatgatcatgtatttgaaaaacgtttattttctactttagagcaaggtgaaaaactacaagttctggaggcaaaaaatgaggagcatgaagcggagctggtcgttggagaattaatcacccatcgttttatgtataaaaccagttatcgtgattatgcaatattgtatagaggaaatcatcaatcaagactattcgagaaagtcttaatgcaaaatcgaattccctataaaatctcagggggaacttcttttttctctcgagcagagattaaagatatgatggcttatttacgtgtactgataaatcaagatgatgatgcggctttattacgtattattaatacacccaaacgagaaataggctccgctactttggcaaaagttggaaaacttgctcaagaaaaacatattagcctttttgacgctatttttgattttgacttaattcaccaactcaatcccaaatcctataatgccttacaaggctttgcatattggattgtcgaactcaatgatgaaattcaacgctcagagcctgagcaagcaatcaaacgaatgttggcacagttacattatgaagaatatttatatgaacacgccaacaaccctaaaattgcagaaatgcaaagcaaaaatgtagccacgttatttgaatgggttgcagttatgctaaaaggagatgagttcaatgaacctatgtctcttagtcaggttgtcagccatctgacgctacgagatatgttggaacgcaatgaaactgatgaagaaagtaatcaagtgcaattgatgacattacatgcctcgaaaggtttggagtttccacacgtttttttaatcggaatggaagaaaatattctgccacatcaaaccagtattgatgaggataatgttgaagaagaacggcgtttagcttatgtaggtattactagagcacaaaaatctctcacattttctttatgcaaagagcggaaacaatttggtgagattttcaagcctgagcccagtcgttttttatctgagttaccccaagatgatcttcaatgggagagaaatgaaacacatgcaacagaacaagaaaaaaaagaaatgaaaaatgccggatttgccagtttaagggcgatattaaatcaataatgctacctattataaattttatacctactttgtagataaatcagacaaccaaataaattttataaaaaatcgtttgacttatttttagaaaaacgtattataccgcccacaaaccgattgtggtgagatggccgagccggctgaaggcgctcccctgctaagggagtatggggtcaaaaactccatcgagggttcgaatccctctctcaccgccatttactcagtgcatccgtagctcagctggatagagtactcggctacgaaccgagcggtcagaggttcgaatcctctcggatgcgccatgttgatttttgattttattgaactctacaataaaacatacacaataatatattcggttaaaaatcaaactaatacgcacccgtagctcagctggatagagtactcggctacgaaccgagcggtcagaggttcgaatcctctcgggtgcgccatcatcaaaaacccctgataaacaaccaactatagccccttgcgatctaaaataaaaaatgcttgaaaatcaagtattttccgcctatctaaaaacaaagtattatatttatatacagtataaattatgatctaaaaaagccttttatagaaattaactgttaccaaaaaatgatccaaaaacaaaaaaagtgtaccaagcaaagaaaaaaggggggatcaaatggcaacttaccaaaaacggggagacaaatggcgagcaatagtccgcaaaaagaacgttctaaaaacaaaaacatttcgcataaaaactcaagcgtttacctaggcgaacaaaatagaaatggaaataatggaaaacttataccaagatgtagctaacataccatttgagcaagttattgacagatacctaaacgaagtaacatcacaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcgaatgtgattgcctacagtaggggcggattacatccgccctttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccaattgattaggattaaatcgccagccctcttcgcttctgaatatggcattaaaacaccactctgaacagaagaatttattctttttctcacgaaaacccaatactaagccaaacacgccttgccaatcatagttagccccttttgtcttcttaaaataggctttcacttgttcttcagtgagattatcaagcggaattaaatcccatttttctgtcttaagggtcatttctttttttcgcacaccgccatcacgaggacttgaactgtagcaatcgtaggtgatatacggataataatcgccacttaaaaacgccgtttgctcaatggcaatttcacaatgactgtattgacctttcgtgattttacgaataagcccatctgtaaatcggtcatagagactaccgcctcgccccttgtacagagctaaatacaccttactcattgccttgctccttaatgtagtcgtgataactgtktgtccacccgtccgaataatcatattccgccggattgtccgattgctccatagcggttttatgtttcaaggcattagcatgattacttgttttagcattcattaacgcctgccaaatttgcattaatttttccttatttatcatcaaaacagcgttatccgcacaagtccacgcaatttccatatcaccgaataaatcataactggctttgacggataagatattccgctccgccgtagcgtccgtatcaatccatttgcccaccgcttccacaaacaccccgccattgattttttcatctcgcaaggcattgattttctctcgcatttccgcccacacttgggttaaatgtgcggtttgattttcaggcgaaataacccactgccccttttcaatatgatgaaatggactgggttgcgggtcggctaactgcggataacccttttcatctgtgattatttgtttgccttctgattgacccatcagtaaagagcggtataaatcttcggagatttccaccgcaccttggggaatatttttgtgaatgtggctcatataaaagccgtctttgaagtagattttcatgtgttgtccttggttgttgtttttgctaaaataaacttatatttaacttatattctttattcatgaagtcggttattttccaacccaaagcgttaaagcaattaagaaaaattccaacaggggcgaaaattgcacgaaaatgccaagaattaacgcattttcctttttgttctaatgtaaaagcccttgttaatcatcgttacccctatcgttttagggtcggcgattaccgagttttctttgaaattgccggcgatatgatgaatattatttccattgaagaggtgaaaaaacgagatgaacgcacttactaacattcaatatttacatgatgaaagcggacaccctgcttttgccgtcatgcccatcgctacccttgaatggttaaaacaacaagcaaaactttcctctcctttagatagtggcgtgccttttgctgtggcgacttttgccttagaaaataattgctccgcacttgttgcatggcgtgagcatttaggattaacgcaaaaagacatggcaagccgtttaaatattactcaatctgcatatagtcaatatgaaaaatcatctcacttgcgtaaagccacaagggaaaaatcgcccttgctttaggaattcatgcgacgcaattggatttttaattgtcattatttgtcctctttccaacgtccgataacaagccattctgacttacccaagtaccagttagtgataattgcttgggtatttgtatccgcggccataaatatccagttatattgtcctttaccactcgctctatcttcgtatttttctgttatgaaacatcggtaatttttatccacaaaggcaattggaaataccacgtgatttttcacggtataaccttcacttttatgagtgaaaataccagtctgaatcatcgtaccatcaggatatttgcgtacctcaacattaccgattttttgatagctaaactgagaggcaacggcactgttaaaatcggtaatgtggtttgctgtgtgcaaatgccctaaatccgatttgccctgcaacgctacagcgattttacttgcgtccatcattccttgattatcgacagttccgaaygcyttaatccaaaattgtacatcgtcaaaggtattttkggctttaatgcacaatttgagaacaagagacttaggacgagtttcttcggcacctgaatagaatattgctccgttagtgcggattttataattatccgcagttttattattcccagtagcaattgtgtcattattgtctacatggtactgataattacttgaattatggtttgtgccataattyaarkaatgcgttttaattgcatcctcttgtaccctccccacaaccagctcatttgctgcattacgcaaaaaacggtcttccgctttgggracattttgaataycgccgtattttttagttaggtatttatgtaattcagggtaggtatcttcttttaccttttccttgatttyrtcaaackcaayccarccmtywggratctcatctgtcgcaaaatacgccgtcataccgacatctgagcgagttaaattgggtaaagtgtttttattgcctaaagtgcggtataaatcggggtaggtgcgttgktcaatagtcgwyccatcgcattttaaaaagccrgtgggatttktaayttctttyggaaacgccacaatcgcccccaaaggcacaccatcaccgccgaccgatttccacgctgtccaaattgaaccattaaaaaagcgagttttgacgccggtatcgttcgctttgcgtgcaatttgtcgcacggcggtagtttgcccaccgctcaccacttcaacatgccacgctcnnnnnnnnnnnnnnnnnnnnnnnnngctcgcaaaataataatgcccgtcggttttgtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacagaaaataaaatacattaaagggcggatgtaatccgcccctactgtaggggcgaatcacattcgccccatgacatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatggggcataagtgccatcattcttattgcggttatttgctattttttaatataaaaagacaataacgacaaaaactacggtggttctatgaaaagtaaattgactgttaatgattttattgaccttatttttgtgttaattgtcgcgtgtccttaccttatttgttatttttattttgatttaagcgttgggctgacgtttatttttggcagtgttgctttattttttatctttgtgttgttttatgatacgtccaatcgtgataaaaattgttgccactgcaaaaataagaatttagatgatgacatctaatcaatattttcactcaatgcgttgatcacaaacgcttcaatcatttctttgtcccgttccgtaaggcctagtaattcacgcttggcgtattgtactttgtgttctttgtgtcgttctactcttgctcttaatccatattgatgaatagtggcgatgtaggcggtatttccgctaaaccctagttctataccgtctttttggcggcgtagcttcatgtgccttgcttgggtgatttttttaaacatggcttgggttttaattctgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnataaaaactcaagcgtttacctaggcgaacaaaatagaaatggaaataatggaaaacttataccaagatgtagctaacataccatttgagcaagttattgacagatacctaaacgaagtaacatcacaaaaaagtaggagtagagtgttccgaaataatcacatcatcattgagtacttttaccgatattttttattcaccttaactattctacttttcaaaagattgtttataaaagaaagcctgttttcacaggcttcctatttatctcattagaatgttagctctgcactaagtttgaagttacgacctggggcattgaagcggttgaaacctttgccggagacgtaatcaattttattgcttgtgccaaattgtctaattgaacgagcagaatcccaagttacatatttgcgattagtaagattataaacgccaaattgtaagagcaaatttttgatcggtttggcgtaagcgatgacatcaaccaaagtgtaagcatcacttctccatctaatagaactatcagtggttacattagtattaccgatattttcgggattaattcttttttcttcaatttgtgttcctctccacgcatcattatatgtatcagaggcttttttagcggcaacacgagttacatataaatccacaccaaatttatcatttttattatgataactcagcccataaatgcttgtttctggctgaatagcattcattggagcggtaacattaataaattcatttgggtttgcagggtctaaatactctttaactttcacttgccctttttgcttactgaatttataactaacatcaaattcactcaaggctttatgcaaaacgctcaaatttaaacgagcgttaatctcaatcccacttgatttagcggattctctgtttatattttgcctaatttcatatggagttttaccaccatttgaattttggtgatacccaatcgttctggcaaaatcaatgaagtttttatacttcgtttcaaaataattgagggtaataaagccaaaatctttatagaaagttagtgcgatttgattagttttagctaactctggctttaattgaatattaggtacaacatgtaaagtatctccatagttagggttaaaatcccccattttaaatgcgaaatatatttcatctgatgttggggctctaaaaccttttgagtgtttaaattgtaagcgcataaaatcaaaaggatctgtatttacaccaaaagaataggaatgtgcagaaaaatttttttctttaacaaaggcatcaatattcgcttgatgacgagccaatttattttyytccgcaatttttttattttgtgcaacagcgttatcatacgctgctacagaatcatcatatttccttttttccttattatatttatctacattattataaccatactcccagatcttaggttcaggtaatttttctggtagtgcgactggtttatagggatctttaaaatcatgagcgaatccaccgacaatatcatctggaatttttggggtgacaccggcagtatagctaggctgatatttaatttgatcataacgatagcccaactcgaaactaatacgatcattcaatttaaaatcatccgcaaaataaagggcccttgaagttgctttaacaggaactaagaaagagaaaatattgcttttaccacatagactagaataacttgttttacaattctccggatacaatgcccaccatttgacattgatagctgaatcacccgattgattaaccatttctttttgggatttagacaaagagccaccgtaacttatattgtgatccgttttccctaacgcaagatattttgtgaaatctaaattaaattgtttggtgtttgtgttcaaagagcggtctgtccaaagattttggttaaaacccaaagttgaaggtaaaattaatctatgtgaatctagtcccgagccaccactttttaatatcgctaaattacgctctttatctactttaaatcccaatctttggggcttattgtctttatcaataacagttattgtcgagtcaccctctgcatctttgtctgtggaatcacaattaatgccatcacaagataataaaagaggtacatttgtttggtgtttcttaatccaattattgttttcctcaagagttaagtcagaataaatttgaccatttgaaattaattgctccgtaattgtttttgcatatatagatatcctacacttatcagggtgttgagaagatttatctttataacaacttgttacattagtagggacatcctttaaaactcttaatttttcatatttctcttttatatcatcaggtatcttctcgttccaagtatcaaatacatcttgactaatatattcataataagtgcgttgctgatttgaatatttatatgtaataggatttccatctttatcaactaattcattatttttatcgtatttaattcccaatggatttaatgaaccaatacatttatcattcccatcacaataatcttcatttctagctcttgttttaattttttgctcggaataagtaaatttcatcgtatcccataaaggattgctagaataattttcataagagaatgcatagttggttcgttttacctgatcatcattatgacgatattcaagttcgggaggatcatttgatttttggagaccggttgcttttaatgtataggaaagatctgctcctttagagcggctatcatataaatcggcggcaacagtaaagcgatgattttctgtgggttgaaaagacaattttagtaatgtactgtctaaatgtttgtgataaggatctgctttttctcttcttttaccttgtactgtggcatcaaaatggttataaccatagttctgtagttcatgaccattacgttttgttttcactaataaggcatcaaaccatttataacgaccggctaaggtcatggaatctatatgttgacgatccgcactgttgtaaccttttttgtaagaaacataccagtctttctctgtgagaaaatctctggcgtccttcgttttaaaaatgacagcaccgcctaatgcaccactgcccactttgattgaattagctcctttagcaagttgcacttgtttcagcgtttcaacttccgcactatttctcgtattattaaaattaccatagccttcaaataattctttaaagccctgagaactcaacgtttccgcttggtgtaaaccatctatcgtaatggcaactcggttttcatcgacacctctcattgcataaccactggtaccgaatcgtcctttttccacaacagtaattcccgtttcataacgcactaaatcacgagcatcctgcacttgctgacgtttgagttgttttgcacttttaattgtttcgccgacctttttttgttgtatatcttggtcatctaaatctgatacaactttaatctcacctaactccgtgatagttgagttagtttgagcctgagaggggggggaagtgagccataaacggacaataccattgtggctacgatagagagttttattttatgaggtgcatgaatttcaaacatatttctgccttgcattaaaaattaagtattttgatggccttcaaccaaatgaacgaagctcactaaatcttcattacttacttggaaagcttgaccaaaaccttttacaaataaaccttgaatcggtttaaaactaaataaataaaaatccttataagtactaatttcatcaattaatgcaccatggcgttctctaagaacagcaatacttgctttccattcttcggtttcacgttcaatcacacgagatgtggcatcaaaagataaacgacggcgagcaaaaatctcacgacttttactttcgtcttcaataagcattaaggaaactttaggtacttcctgtaaattacgtgcgtgacgggcaatagttgaaataaaaacctgatattctccattagaaatggcgaatggggcatagctcacattaggtgtaccatcttgtccaacggtggctaacataatggttttgctttgtgcctttaattcttgaatttctgggcctaatcgattttgtaatacttcttgacggtttgttgctgtcattttgatttcctcgttaattaaataaattgcttaaatttttctacttggtgcgggaataactgacgttgttcatcacgaccaagatagaccttaaaaatggtttgtccgttgttagcaataaaggcgatgttgtaactttctttgcctctaaatggcaaactgacaaatgcgatttgggcgagattgctgagtttcaaatggccatgtaaggtgccttcattatctttcatgttgaggttgtaataaccacgcccaaccatacctgttggaaaacgatctttaatttcaaaaattgaaccttctttttcaataatggttgtaaaagttccccattcgctaatttcagtcataatttccaccgctctttcagcagagaaaattcgcacaaattcctcaggtaatgcacaaagaatattgccttccggttgctgaaaatgttccgccatctcaagcgtgatagaaagagggttttgagcaatgtaatctgcgatttgctgttttaatgtgtgcatataagttttacttaaattagaaattttatttcataactgataattattcttaattgtatttgaatttatctactttgaaaagaggggagaagtggagttgaatcgataattattataattttttaatttaacgttttttagatacttgaagtctaaaataacaaccttatattacgaaaactgctacaagaattaaaaaattatgggaaagaaaaaacgttcagcaagctccagccgttggttaaatgagcattttaaagatccttttgtgcaaaaggcacataagcaaaaacttcgttcaagagcttattttaaattggacgaaattcagcaatcagatcgtttatttaaacatggtatgacggttgttgatcttggtgctgcaccgggaggttggtcgcaatatgctgttagacaaattggagatctgggtcgagtaattgcttgtgatattttggaaatggatccaatcgtcggtgttgattttttacagggcgatttccgtgatgaaaatgtattacaggctttattggagcgtgtcggtgagaaaaaagtagatgtggttatgtctgatatggcgccaaattttagcggtatgccagcggtagatattcctagagcaatgtatttagttgaacttgcccttgatatgtgtaaacaagtgttagcaacaaatggatgttttgtcgttaaagtttttcaaggagaagggtttgatgactatttaaaggaaattcgatcattatttaacacagttaaagtacgtaaacctgaggcatcacgtggacgatcccgtgaggtatatatcgtagctatgggttatatgggatagaaataactggtctgttgtcttattaataaataatggccaattaatctgataactttaaatccaaatagatttatagtatcttatgaaaaatttttaattactgaaatatggagttcaaaccttgaacgatatggtgaaaaatatagtcctttggatcgtagtcgctgttgtcatgatgacagcctatcagagttttagcggaaactcatcaaataacgcaattgattacaccacttttattagcgatgtagaaaataaccaagtttcagccactaaatttaatgaggtcggtgaaatttttgtaactaaaaaagatggttcaaaatatacgacagttcttcctacaccgttagaagatcgtaagttattagatgatctgattaaatcaaaggtgaaaattgatggtgcattgcctgagcaacggggatttttatcgcaaattttaatttcttggtttccaatgatcttattaattggcgtttggttcttttttatgcgtcaaatgcaaggcggtggcggcaaagcaatgagttttggtaaaagtcgtgccaaaatgctaacgaaagaacaaattaaaactacttttgccgatgttgcaggctgtgatgaggctaaagaagaagtcggtgaaatcgttgatttcttacgtgatccaagcaaattccaaaagttaggtggtaaaattccaaaaggaattttaatggttggacctcccggtacaggtaaaaccttattagcaaaagctatcgccggtgaagcacaagtaccattttttacgatttcaggatctgatttcgtagaaatgtttgttggtgtaggtgcttcccgtgtccgtgatatgtttgaacaagcgaagaaaaatgcaccttgtttgatttttattgatgagattgatgcggtcggtcgtcaacgtggtgcaggtcttggaggagggcatgatgaacgtgaacaaaccttgaaccaaatgcttgttgagatggatggctttgaaggcaacgaaggtgtgatagtgattgcggcaacgaatcgccctgacgtacttgatcctgcgttgactcgtccaggacgatttgaccgtcaagtcgttgttggattgccggatgtacgtggtcgtgagcatattttaaaagttcatatgcgaaaagtgcctgtggcggatgatgttgatgcaatgacattagctcgtggtacaccgggatattcaggtgcggatttagctaatcttgtgaatgaagccgcactatttgccgcacgtactaataagaaattggttaccatgttagagtttgaaaaagcaaaagataaaattaacatgggaccagaacgccgttctatgattatgaccgataaagtgaaagagagtactgcttaccatgaagcagggcatgcaatcgttggttacttagtacctgaacatgatcccgtacataaagtgactattattcctcgtggacgtgctttaggcgtaactttctttttaccggaaggtgatcaagttagtattagccagaaacaattggaaagtaaactttctactttatatgcgggtcgtttagctgaggagcttatttacggtgaagaaaatatctcaacaggtgcttctaatgacatcaaagtagcaactaatattgctcgtaatatggtaacgcaatggggtttttcagataaattgggaccgattttatattcagaagatgaaggcgaagtgtttctaggtcggtcaatggcgaaagctaaacatatgtctgatgaaaccgcacatacgatagatgaagaagtaagatcaatagtgaatcgtaattatcaaagagcaagacaaattctgattgataatatggatattttacatgcaatgaaagatgcgttagtaaaatatgaaactattgaagaagagcaaattaagcaattaatgaatagagaaccggttgtcgctcctccaggttggactaataatgagtaaaatttatttgtagttttggcaacgcttagtaaaatcttccgactatgttgtaggttctgattttttaataaggaaaagggattaaacgtcggtaatgtaacagaagtaaccccaaacaattattctttatttttggtagagtatgaatttgggattttgttacgagacggtggaagaacagttaataatattacaaaaaacataataattggggctatctactatagcccctatttttattgcaatttagataaagtttattttttatcgttactgagttttttattgaaaaataaatgtgattaaaaaatataaagactgagagtatagttatgaaaaaaatttttttaaaagaattacaaatgatttctttagatattttggattattttcatcatatatgtgaagcacataatatacagtattcactgggggggggaactttgattggtgcaattaggcatcaaggttttattccttgggacgatgatattgatgtatatatgttgtggagtgaataccaaaaatttgtctcagtttggaataaattatcacataatttctataaactatctcctattgaaacttttgatggggatgttgtgggggaaatggctaaaatttatgatgagagaacttatttatcagaaaaacatagggcaagtcatatatttatagatatttttattttagattatgtgcctagtgatttaggtattttgtataaatctatgaagaagcatcgtagattaacacttaggttcaagtctttaaggaaacgtttttatcgagctaaagataagagcggttgtaaaaaaatacttggtaaattatcacaaatttattatgaaaaaatgcaagctaatctcagtcgattaagagaaacgtacaatgaaaaaaacagtgataatatcggtctttttttatctgattatgcttgctggaaaaaatcttatatgcctaaagaatattttcggtcgtttaaaaaagttaagtttgagaataaatatttttatgtaacggaatattatcatcagcacttaacagattattacggtgattatatgacattaccgccggaagatgaaagatctcctaagcatggaatagaagtatattggaaagagtgaggttacaaaattttatggcttatttttttatctaaattaacagcaaacaataaaacaatagataacttagagaaacaaaatgttgtaagttagattaattgaaggactggattttgtatgttaaatggacccagtccttttagtttgatacaaataatatttgtaataaatttctgtaatttttattttttaaagataatgtagagctgaaataacatgtgtaatgctattaaaaggttagtggggtgatacattttttagttaattgaaaaagtatcaccttcgtccattagattttagcccgatttttaggtatagccagtaaaattggtcatgtttcctattattaaaatttcattgaaatactcatcttaacattacgtccaacacctgaaacttttgcacttagataagggttgtacttgcgattaaagatattgtctatgcttagagaaagcttcattccgtgtattttcttaggttcccatatggcaaatagatgatgtaatgagtagccgctggatttaggaagtgaccaataccctgcttcaggatcgttatcgataggtgatctatcttggcgacggaaaaactcaccttgccaaccaattgatatattccatttgggtaggtttgtacctaatgtaattattgccttacgaggagggatctctgctatccaakttttgcttctagattaattaaaggatgatctgatatgtaagtccagtctagagcaacactttcatcagttagtttgcggtataccagtttccttttccaagcaatatcttctccccatttttgtatgtcggatatacttggtgagggtaaattatcacgcatagcggcaaatggtgtccaaccggagttattggagcgtacagctgaaagcgtcaattgttgcttatctgaaggataaaaattgacttttaatagatagctcttattgtcattttcagagtataagaaacgagaaccatcggggcgttttatgttctggctattacgaacggttgtgtaaaataagccctctagattttttgcttgattgcgtagaaaaattgcaccgctccaaatattctgtttatcattcgtatggtaactatatttagcaaatccaccaacattttgattttcattgagaaagtcgctcggatttttagtcataaattttaaggttccgccaaatccgccattcccatattttgtagaaaagctgcctttatcaacctccacccgacgcagtaattccggttctataaatacagatccttgacgatatctttcaaagtttttttgtataccgtctaattcaatacggacatcttcactatcaccaaatccccaatattgatattttgacctcccggtctaggtgaaccggacatattgacaccgggcaaaacattaaccaaggctgcggcattgtcagcttgctgtcggtcaatatgttttgttaatagtgttgaacgtccgatatcatactgttcattttgaactaagatgacaggaagagcgtcgtattgttgagcgattaatttgcttgtataaaacgtagatgaaagcaatatagtgatgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgatgtatgaaggggggggaatttaacaaatttattgcacatgactatcgtaattaatgtaaataattgggaatataactaattatcattttaatgtaaagatttttatccgagagaataaaaaagaatatgaattgcataaacattcaatatagagttcaaaggtaagctactttgggcgtttttcagtgttttattcattatttttgtatttattctcaaaaatttttttatttttgttcattccaatattccgctataattgaccgcacttttaacttgattgcgtagcagagcaaatgaaattacaagcaaacaataaaactttggatcttactttacctaaaatcatgggaactttaaattttacccctgattcattttctgatagcggacaattcttttctttagataaagccttatttcaagctgaaaaaatgctgaaagctggtgcttcaattattgatattggtggtgaatccacccgtcctaatgcggcagaagtaagtttggagcaagaattggatcgtgttgtgcctttagttgaagctgtaagaaaacgttttgattgttggatttcagtagatacctctaaagctgaagtaatgttggaaagtgctaaagtcggtatggatataatcaatgatattcgtgcattacaagagcctaatgccttagagacagcggtaaaattagggttaccgacttgtattatgcatatgcaagggcaacctcgtacaatgcaacaaaatccccaatataataatgtagggcaggaagtattggaatttttacaaaatcacaccgcactttgtttacaagcgggcatgaaaaaagaaaatattatttgggatcccggtttaggttttggtaaaactgtgcaacagaattataaattattacagcaagttgcccgattttgtcagcaggatattcctgttttagtggggttatcacgtaagtctatgattggtgcggtgttggataaacctgtaggacagagagtaataggaagtgcgacaggtgcattacttgcggcaatgaatggtgcaaaaattttgcgtgtacatgatgttgatgaaacattagatgcattgaaaatttggcaagcaacagaacaggcttagttttaaagagttgttctacaataagttgatttcacagagtgaaggataattttgcttctcttgcgttgatgaataatcaaggaacgaaaaatggcggaacgtaaatattttggaactgatggtgtgcgtggcaaagtaggaagttatcctattactcccgattttgtgcttaaattaggttgggcggcaggtaaagtgttggccacgaaaggaacgggtaacgtcttgattggtaaagatacacgtatttccggatatatgttggaatctgcattagaagccgggttggcggctgcaggactatctgccgcatttaccggaccaatgccaacaccggcaattgcttatttaacacgtacttttcgttcggaggcgggaattgttatttctgcttcacataatcctttttatgacaatggaattaagtttttttctgcacaaggtacaaaattacctgatgatgtggaagaagcaatagaggctatgctggaacagcctatggattgtgttgaatcagctaaattggggcgtgcaagccgtattaatgatgcggcaggtcgttatattgagttttgtaaaagtacttttccggcacatttaagtttagataagtataaaatcgtggtggactgtgcaaatggtgcaacttaccatattgcaccgaatgtcatgcgtgaacttggtgcagaagttattgaaattggtacgcaacctgatggtatgaatatcaatgaaaactgcggtgcaacagatatcaaagcattacaaaataaagtattggaaacaaaagctgatatcggtttagcctatgatggcgatggtgatcgcttaattatggttgatcattttggtaataaagttgatggcgatcagatcttgtttattattgctcgtgaggcgttacgttcaggtaacttaaaaggtggcgtggtgggcacgttaatgagcaatatgagcttagagctcgctttaaagcaattgggaattccatttgttcgtgcaaatgtaggtgaccgctatgtgttagaaaaaatgcaagaatataattggattttgggtggtgaaaattcaggtcatattattattgcggataaaaatactaccggagacggtgtgatcgcttccttggcggtattagctgaaatggtgcaacataaattgtctttaaacgaattagcaagtgcggtgaaattatttccacaagtgttaattaatgtacgttttgcaggtggtgcaaatccattggaaagtgatgcagtaaaagcagttgcaacagaggtcgaaaaacaacttgcaggcaagggcagaattttattacgcaaatccggaacggagccattaattagagtgatggtggaatgtgaggatgctgaactggcacagctcagtgcagaaaaaattgctgaggcagttagatctaattaggtgtaataggataatgaaaatatttgtaatgcggcatggcgaagcagaagtgatggctaattcggataaagaacgccgtttaacctctcgaggtcggttgcaagttagcgaacgaggttattggttaaaaacggttattcctgattttgataaggttttggtaagtccttatagaagagcggtagaaagttttgaaaaaatcgatgaggcttatcatcatcaactaagttcaaaacaggaaatttgggaaggtattacaccttatggaagtagtcatttggtgatagattatttatccgtattggcaaataaaggtgttgataaggtcttgattgtttcacatttacctttagtgtgggatattgtcacagaattgtgttctaaacgtagccctatcagtttttatccctctacaattgttggtttacagtgggattgtgagcaaagtgcggtcattacggagataaaatatccggagtagtaatatgcaaaataacgatttcttatccgcctttattttttcaaccagcgttactctgccgacattgtgaatgctgatgttgggtgttacgttacgagcaaaacgagtcattgatgatcgtttcagcggacaagcgactaaaattatttttaatattaccctgcctgttttattatttttaagtatttttaaaaatcctgtggattatagccaacaagtgcctcttttattggtaggagtggttggtacattaattttatttgttggtgctgagatttttgccgcaaaatttgttgtcgataaacgtgaaagaggcacttttgtgcaaagtgtttatcgaggtaataacggcattttaggtttagcattttgcattaatgcttatggggatttagcgttggcaccggcgtcaatttatgcggctgcattaacttttttatataatattttaggtgttattacgctaagtcgttctttatccgatggtaaagtcggtgtcaaaaaaattgttttcaatgttttaaaaaatccattaattattggtatcttactcggtattttggcaagttttaatcaggtggtttttccaaaagcaatcttgacgaccgctgattatcttgcgagcatgaccttacctttagcattaatttgtaccggtgccagtattgatgtgaaaggattatttaagattaatgcggtatctttatgggcgagtatcggacgattactggtcgcacctatttttatggtagtgattggcaaagttttaggtatcaccggtatacatttaggtatcgtgttattgatgtcttcaacacctttagcaactgcggcttatgccatgatcagaggaatgggaggcaatgctgtaacagctgcgaatattattgggttgacaacttttggatctatgtttagttctgttacaggtctgttattactgaatcaaataggctggatttaaataattttttcgtttttatttgattttgttattattcggtaacgtttatatcgtgaatttattttttggcaaaatataaccgcactttggacttatctataaaagtgcggtttaaatttataaatcaatgcaacaaatcattcaaacattttccgacaacggcgtattaagtaaaaatatcaacggtttttgtcctcgagttgaacaaacggaaatggcaaaagctgtagctcgggcaattcgtcaaaaaagtactttagttgtggaagccggtacaggaacaggaaaaacatttgcgtatttagtcccggcgttattggcaaaaaagaaaacgattatttccacaggttcaaagaatttacaagatcaactttttagtcgagatctccccactataaaaaaagccttgaactatagcggtaaaattgccttattaaaaggacgagccaattatttatgtttggaacgcttggaacaagttattgctcaaggcgttttggggaatagagaagtgttggcggatttggcaagcgtacgtcgctggaataatgcaacaaaaacgggcgatttaactgaatgtgttgaacttgcggaagatagccctattttaccgcaactgaccagtacggcagaaagttgtttaggggcagagtgtcctcattatgcagattgttatattgcccttgcacgcaaaaaagcacttaatgctgatttagttgtagtcaaccatcatttattttttgccgatatagtcgtgaaagaaagtggttttggtgaattaattccgcaagctgaagtgattatttttgatgaagcacatcaacttcccgacattgcaagtcaatatttcggtcaaagcattacttctcgccaattttttgatttatgtaaagacattaatattgtttatcgaactgaaataaaagatatggcacagcttggtgtagcttccgacacgctgttaaaagcggtgcaagactttcgcttattgctgggtgaagggaatttaagaggcaattggcgtgaagttttacgccaaagtgcggtagaaaaatcgttcagtttgttacaagaaaaagtagattttacagcggaagttatcaaattagggttaggacgttcacaagcgttagacagtatttttgagcgtattattcagctgaaagcaatgcttcaacgcttacaagcaacagatatcgtaggattttgttattggtatgaaaccatgggaaggcaattcggtttacatattacacctttaaccgttgccgataaatttggtgaacaaatgaaagctaaagaagtcgcttggatttttacctcggcaactttagaggtggcaggaacgtttactcatttctgcaaacgcttaggtattgaaaaggcggaacagcaagttttacccagcccatttaattttaccgaacaagcactattttgtgtacctcgttatttacccgtcactaatcatcgtaacacattaaatcaattggctgaaatgttattgccggtgattgaaagtaataatggatgttgttttgtcctttgtacttcttatttgatgatgaaaggattagctgagtattttcgtgaacatagtcaattaagtgttctgcttcaaggggaaacttctaaaggaaaactgttagagcaattcattaaagaagatcattccgttttggtggcaacgtcgagtttttgggagggtgttgatgtgcgtggaaaagctttatctttagtgattattgataagttaccttttactgcaccggatgaacctttacttaaagcaagaattgaagattgtcgtttacaaggtggagatcctttcaatgatattcaaattccggaagcggtcattgccctgaaacaaggtgttggtcgtttaattcgagatgttactgatcgaggtgcggtgattatttgtgatagtcggttggtttttcgaccttatggtgaactatttttacatagcttgcctaacgcaaaacgtacccgagatttaaacaaggtggtacaatttctggctcaaattaaaaaggagaaataacagaatgatgacaactttattagcacttgatacatcaacagaagcttgttcagtcgcacttttatacaaaggagaagtcacctattttgatgagttggcacaacgcactcatgctaaacgcattttaccaatgatcgatgagattttggtgcagtccggtattcaactaaatcaattagatgccttggtatttgggcgtggaccagggagttttaccggtgtacgtgttggtgcggggattgtgcaaggcttagcttttggggcggatttgcctgtgattcctatttctaatttaaccgcaatggcacaacaggcttatgagcaatatggagcggaacaagttttgtgtgcaattgatgccagaatgaacgaagtttattttagtcaattacaggcagaaaaagtgcggttggaaaatactgattttgttcaatggcaagagttagtcaacgaacaagtttgttcgccacagcaggccttagctcaattaaaagatatccagattgaagattggacaatggtcggtaccggttgggaatatgctgaattcaccgtagcgggattgagtgagaagacgcaaattgatttaccatctgcccgttatatgctttctctggctttgcctttttatcatcaaaaacactggataagtgcggtagaagttgagcctgtttatttgcgtaatgaagtaacttggaagaagcttccaggacgtgaataattcatgatgtgtttatttttctattgctcgtgtacttgctgaattttattttgaagaaaatcttgatttataggggaagattgaaagatgttttattgcattgaggtttttgctaagagaaataaatctgctcaaaataaaaaattgaagtataatgcacccgatttttcacagaaaaatagtaaaaatgatagaaatatcagttaattaaagaggataaataccatgcaaaaaccttggtttcaaaattaccctgagggctcaccgctggaactggatacttcaaaatatgaaagtttgttagacatgcttgataaagctattcgtgagcatcctgatcgtccggcttatgtaaatatggggcaggttttaactttccgtaaattagaagaacgtagtcgagcttttgctgcttatttacaaaatgaactaaaattaaagcgaggtgagcgtgttgctttaatgatgccaaatttattgcaatatcccattgcattatttggaactttgcgtgcaggtttggttgtggtcaatgttaatccactttatacaccgagagaactggagcatcaattacaggatagcggtgcaatagcaattgttgtggtatcaaattttgcgtcaactttagaaaaagtcgtttttaatacgaatatcaagcacgtcatcctcactagaatgggggatcagctctcttttggtaaacgtactttggtcaattttgtagtgaaatatattaagaaattggtgccaaaatataagttaccgagtgcggtaacatttcgtgaagttttggctgtcggtaaaaaccgtcaatatgtacgtccacaagtggaacgcactgacttagcctttttacaatatacaggtggcacaacaggtgtggcaaaaggtgcaatgttgacacatggcaatattattacaaatatttttcaagcggcttggattgcctcaccctttgtaggcgatcataaaaaacagcgtaaagccattatagctttaccgctttatcatatatttgcattaacagcaaactgtttactttttattgaattaggtattaccgcagttttaattactaatcctcgtgatattgacggtttcattaaagaattaaaaaaacatcgttttgtagggataacaggggtgaatactttatttaatgccttgctgaataatgaaaactttaaagaggttgatttttccgcattgaagttgtctgtgggaggcggtatggctatccaacaatctgtagcgactcgttggcatgaattgactggttgcaatattattgaaggctatggaatgacagaatgttcgcctttaattgcagcatgcccaatcaatgtagttaaacataatggaactattggtgttccagtaccgaatacagatattaaaattgtcaaagatgacggttctttagctgaacttgatgaacctggagaactttgggttaaaggtgagcaggtaatgcaagggtattggcaacgtccagaggcaacggaagaagtgttaaaagacggttggctggcaacgggtgatatcgttattatggataaaacttatagtttacgcatagtagatcgtaaaaaagacattattattgtatctggttttaatgtttatccgaatgagattgaagatgttgtaatgcttaatcctaaagtagcggaagttgttgctattggtattccggatgaagtttcaggtgaaaaaatcaaaatttttgttgtgaaaaaagatgatagtttaactcgtgatgaaatacgccagcattgtcgtcaatatcttacagggtacaaaattccgaaatatattgaatttcgtgatgaattaccgaaaagtaatgtaggtaaaattttgcgtcgagtattacgtgatgaagagctggcaaaacatgcgtaaaaataaatatcaagtgggcgattaaacgcccactttttgtgtatcgttttacccacaatgatgtagccatgagaaaggttattgaataatagataattagcaagtatgtccgttttaataaaagaaatccaaaattcaccgcagtttcaattgattactacaaatgatcgtttatatgagatttgccaacaggcacaacaaaaaacggtgattgctttggatactgagtttgttcgcaccaaaagtttttatcccaaactaggattgattcaactttatgacggtgagcaagtgagcttaatagatccttttgagttgagtgatttttctccttttattcaacttttagccaatcaaaaggtcacaaaagtattgcacgcttgcagtgaggatctggaagtttttcaacattattttcagcagttgccaacgccaatgttagatactcaaattatggcggcatttttgcaacatggcaattccattggtttagctacattgctaaaacattatttcaagctggaaatagataaagggatttctcgcactaattggcttgctcgccctttgtctgacgtacaattgcactatgctgctgccgatgtatggtatttattgccattatgtcaacgtatgcaacaaaaattagctcaaacctcttggcaaagtgcggtgcaaaatgattgtgaaaatttgttgaaaaaatatactcagataaaagatagtgacaatgcttatttttctatatccggagcgtggaaattaaactctcaggaattaatgcgtttaaagctgttagcaaaatggagacaagaagaagcgataaagcgtaatcttgcattaaattttgttgttcgtgcagagcatttgattttattagcacaacataatccaaaatatacttcacagctgttatccattggtttatctccgctggaagtgcgtattcatggtaaaaaaatattacaactcttagagaaagcaaacaaagcaccggcgtatgactatccaccaccaattttgcgagtcactgatgatcatcgttatcgtgtagcaattaaattgttacaagcaacgttacgggaaatcactccggcagatttaccgactgaagttttgtcaactaagcgtatgttagatcagctgataaagtggcattggattaaacaagacaatcctcatgatttacctgatttgctttgcggatggcgtagggagtttggattattgttattaaaggctttgcattaattagatactttcttaaattttttggaacgaattcaagaaatcaaagggtatacaaattgataccctctatatttttagacagggaagaatgttgatctcttccctatatgtcaatctttaatcaagatatttgattactttaattactttatttacccctgaaacatgacgagcgacttctgcagccgcatctgcttgagattgagttaaatttcccattaagaatacttcaccattttcagtaatcactttaatatccgctgatttaatatttgaattgacgaataacttagatttaatttgtgtagtgatccagccatctttgctaatttgtccaatagtaattggttgtgcaaggcgtaactcattatatacttcgtcaacaagttccacccctctggctaaattagttgcctgtacttttaaactattattcggaacttgtccgattaataaaattcgggagctataagaaactacattaacacgcccttcagcttttatttgtgcatcttttttaatcgctgacaagactttttcttccagtgtttcatcatcaatttgagtacctgctgttctcggatccgttgcaacttttaccgcaactgccgtaccggtagcaataccaatcacagtggctgttgcacaaccttgtaataaaagagctgaactcagcaatagccctaacgttttatttattttcatctgatttctccttgttgaaattttgtctagtttgggttgaaacatggctttttgtcaagaactatgaatgtgaaaataatgaataatcaataagctcacataatgtgttaataattagcagatgattttcaagaatacgactttccttaccggtcggtactgaaatttctaaatcatttgccgttaaaaatccttgtatatgaccgttattttcaccggttaaagcgataatttgtacatctttatttaatgcacattgcaatatatttagcatcgtttcttcattgccgaaaggagaaaaaataattaatagatcaccttgttgtgcaattgcgttaaattgtctttgatacaacatagtatgacaattttcggaaataatggcagaaccgaccgcactatccaaacttaacagaacggaaggaaagctagggcgttccaattcatatctattgagtaaatttgctactaaaaattgtgcattagcataggatctaccatgcccactgacaataattttattacctttcagcaggcaatttacaatatgttgagttgcctctacgatttttgttgcaagtaagctggaggaagaaatttgagtttgaatactttccgtataaatatctttaactttttctaacataatttttattcatcaagaaaattaggtatccattggatatcatttgttgttgctccaaaagcgaccagatcgaaacggcagtccgcatcttctaaactggaatcatattgtgctaaccataggttggctgcatcaagccatttttgctgctttttccaatctacactgtcaattgctgaaccgaaaatttgatttttacgctgacgaacctcaacaaaaacgatcgtttgccgatcttgcataatcaaatccaattcaccgcagttaaagcgttggttagcagcaataaaggttaaaccttgtctctctaaaaagaggcgagcctgatattcaaaactcgcaccttgttgacgtttggattgtatcattcttcgttaatcagatagatgctgtcatcttgctcgttaagcggatagatactgccattttgatattggaaccaagtcatatcacgttcaacattacagttagggccggcactgagttttcctgttaacccatcaatggtaaatccgggaatttgacggaattcattaaattgatttattaataaccaagcatcataacccatagcatataaatgcattaatgagtaatcattattggtcattttttcaatttttttatattgttccgattccctatctttgaagaacggaatatcactaaattgcagattattcagaaacaaacgatgttcaggaccactgttaggcgaattactacgtgaacttgcataaagttttagggtcggattaatattatccaacactgctttaatttcagctaattgtttgttattagcaataatatacacgctgtcagtactttcacttaaccccgattttaatgcaaaattaatatctgcggtttgattatagaatttaatattggcatcagtacccaatagttgttgccaacgtagagtaaatgccgctgccgtgcgtcgccccagattattttgcggtactaaaacaagtggaatacgtactgtatcattccacattttacttgccgcactttcagcttcatcttcaggcgataatccataataacaaaggtgttcaattgcccgtgcattaggcgtagagttcaacgctaacacatttaaatcttgtaccaaatacggattattgactataacatcaacattttgtttgagtaatggtccgacaagagtgttaattccctgtttttttgcttgattaataatttgttctatagacattttcattgagtcaaatacgtgaacttgaacattgtaattgactttggcatcatcaaacccgtttttaattgtttcaccgataagtcgtgtattgccgcttaaagggagtattagaccgacttgcgttaaagtagtttgttgaaaattggcaagcccttgtaattctgtaggtaataaatgtgctgccgtatgtgttggataataatttttccaagtcagtaatgtttgaattaattgtgcaggttgattaaggttatcattgtatagttgagctaatgttaaccaaccgctcaatgtaatatttccttccgcatcagtattatttagtacttcactatctgtattgcgtagcaatgcccaagtgcggtcattattttgttgttttcgttgaatatcacttaaaaaattatccatttgaattcgagcttttatcgctgaaatattatcatgacgattttctgcaatacgagaaacaatctcataataacgtgatttttgtgaaggactaagtaatgtcaagtgaattaaagataattgatattctgccgtttcatttttgcctttaacggcagaaatatgagcttcaatcagggatttatctagtttttgttcatcatttaaatctatcaattcagcaagatatgcttccgcttgcgggattttattttctgttactaaaactcgagcagctaaaagtttataggtttgtaaatcttgttgattttgtgtttgttcaattttccgaatgtaaaaatcagaacttgcattggcatcattttttaagcttgccgtaaagctactgcctaataaattgacacagcctgctaaaaaaaacataactaaaatcgggagaaagcatttttttaagcgtaaaccttgcattaaaatagataacataaattgctccttgagtatgtgcaatgtaaaatgcacggtgatcttacttatctcaccaattaaaagcaaataaaagaagtgaaaaatgaataattcgacaggaattctatacgttgttgcaacgccaatcggcaatttacaagatattactcaacgtgctttagatgtatttaccaaagttgatttgatcgctgcggaagatacacgtcatagcggtttattactgaatcactacggcattaaaagaaatttttttgcgttacatgatcataatgaacaacaaaaagcagatgtactgattgagaaattacaacaagggttaaatatagcacttatttctgatgctggtacacctttaatcagtgatccggggtttcacgtggtgcgtaaatgtcaccaagcaaatatccgagtagtcccattacctggagcttgtgcggcaataaccgcattatgtgcatcaggcatcgcttccgatcgtttctgcttcgagggatttttacctgccaagagtaaagcaagacgagataaattggcaaacttagcaaatgaagaccgcactttgattttttatgagtcaacgcatcgtattttggattgcttgactgatattgaacttgaattgggagccgatcgctatgtagtgcttgcacgtgaaatcacaaagacttgggaaacaattcgaggagatcaagttggaaagttgcatcaatggctacaagaagatcctaatcgaacgaaaggagaaatggtgctaattgttgagggcaaatcaaaaagagaagatgaaacattttcccctcaagcgattaaaacattacaattggttagccaagaattacctttaaagaaagcagcatctattgttgctgaaatttatggctataagaaaaatgcactttaccaatttggtcttattcaaggttactaatataatgaggctataatctcaggtttaatttgggtataatcgccaaactttttaggtctgatttttaaggacaaatatgagtcaatttttttatgttcattcagaaaatccacaatccagactgattaatcaggcagtggagattttacgtcaaggcggcgtaattgtttatccgaccgattccggttatgcactaggttgtatgattggagataagcatgcaatggatcgtattgtgaaaattcgccagctacccgaagggcataattttaccttagtttgtagcgacctgtctgagttatcaacttattcagtagtgaataattcggtatatcgtttgattaaaaataatacaccgggtcgttatacttttattctaagtgcaacaaaagaattacctcgtcgtttaatgacatcaaaacgtaaaaccatcggtattcgtgttccggataatcaaattgcgttagatctattaaaatccttaggcgaaccaattttatcctgctctttaatgttgcccggagaagaatatacaacacaatccgatccggaggaaattcgagatcgccttgagcaccaagtagatttaatcattcatggcggatatttaagtcagcaaccgacaacagtagtggatctgacagaagataacccggttattttacgagaaggaagcggtgatattcgcccttttatataaattaactttattcattcccattatcatagacgcttgtgaaagcgacagtaaggaaaataaatgaaagtaaataagcaaaaatcccgtccaactaaaccgcactttgcaaagcaggttaccaacgagtctatgcgggataatacgaagcgatttgcaaacaaagaaacagtatctgaacgtaaaagtgcggtaaaaaacactcaaatttctctaacatcaacaaaatcaactcatgctgtcaatcagcaaaaagtcgaaggggaaagactacagaaagtgttggctagagcaggacaagggtcacgtcggacaattgaagcaatgattagtgccaatcgtattagtattgacggaaaaatggcgactttaggtgatcgtgttgatatacattccggcgtaaaaatcagaattgatggacatattgtcaatttaacgcaagcacaaaaagaagtatgtcgagttttactctattacaaaccggaaggagaactttgcactcgacatgatccggaaggaagagcaacggtttttgatcgtttaccccgtttaaacggatctcgttggattgcggttggtcgtttggatattaatacatccggactacttttatttacgactgatggtgagttagctaatcgtttaatgcatccacgacacgaagttgaacgcgagtatgccgtgcgtgtttttggggaagtagatgatgcaatgattgctcgtttacgtaaaggcgttcaattagaagatgggcctgctaactttaccagtattaaagcaacaggcgggcaaggaatgaaccaatggttcgatgtcaccttgatagaggggcgaaaccgagaagttcgtcgattgtgggaatcacaaggcattcaagtaagtcgtttaattcgtattcgctacggtaatattaaattaacgaaatcgttaccacgtggcggttgggaagaaatggatctaaccaatattaattatttacggaaacttgttgggctaccgcctgaaacagatagcaaaattgatactaaaaaacctcgtcgtataaaaacgggacaaattcgtaaagctgttaaacgctatactgaattgaataaacgttataagaaataaaaaacttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaacttatttaaaagtgtgaattaactcacaaattttaaattacgtatttgcattatagaacatgattttttacattgcaccttataaaaagtgctataaaaaagtagccaacatattttgctttccgagtagtgcctcttttgaggcactttttttgtgtttgaataaaacaaaaaacctagcaattcaaaggttatcgctaggttagataaataaattagttaaacacgccgctgacgccgacacggaaacctattcgaccacggctgtcggaggacataccgccggagacagcccatttaccatttgcggaagttctaccgaggtttaaagagaccgcactttcgctgctataacgagcggcaccggcggcataagaccatttacccgggacgaaaggcacatctttaaaagccatcgcggcggcgataccggctttagcgtctttattgacctcttcaacacgttggttagttgcgtgtaattgactaccgtttactgcgtcagttgagcgatgagaaagcaaaccggcrgcaacattttgaatacgrcgttcattgcctttgytkcccacggaaacgacrcctttygcatcaacrccggcgtaattrccgtygactttrccgataccgccygtwgtctcrcctttttcyacataagcrgaaswatcrcckaggaagacggagttatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccaacctattgctgtagataattcattggtgctactggattgataaccaaatgcattactataagtgccagaagctgtagcaccttgtccaagagccgaagcaaatttcgcagttgcttttgcctcatcacctactgctactgcaaatttttcagttgcttgagaatttttacctatagaaaccgcttgtacacctgcttctgctttatgccccattgccacggcataagcttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattattactatttgattgttgagcttgagccatagccgaatgagcagttaaaacaactaccgcagttaaagataaataaaaaattttcacttaaaagaaatccttaaaaaaagagttaacatagaaaaatcataaaaaagctaaccgcactaagaggcgataatttatgacacgccttaaaaagaggtaggggacctaccaaagcgggcgaaattttaagcgggggggggtactgtcaataaaaaaatgaaaaaatgtgaaaaaagataaaaaaagtaaaaaatgaagayaagarkywaaaaagtgagaagtacaagtaaaaaaagtaaaaaaagcccgcactttttaacaaaaagtgcgggttggattgggaaatttygggttatrtagaaagcgagaagctatgatgatagttttggcttgtggcttataagtaacgtttaatccattaagattttttttaccttctctttcatttggttgaactccaatgatattcattggagagtagttctgaaagttcattgaaagtattttgcgtaaaaaagaggaatgctagtctcttaatttagcgggaggaattagtagaataatatccgcccatcgcactgtaaatcgcattttgactttgaattaaactgtatttcgcattcagaatagctaattgagaggtattttctatattagctgcattaagccattctattaattctgcgataccggcatcatagcggtttttgtaatattgcgtaatacgtttgttgtaacggtaagtctcttgtaaatttgcaacattttcttttgcttgggtataagagaaatagaggttgtctatttcatttagagccttggtgatgttttgttcaaaactcagttttgcattttcataagctgcctcagaaattttaacattccattttactgtattccaatttaagaaaggtaagtttatgcctaccgttcctgtcgcaatcggtatgttgaaagcattgtcaattttattaccgcttgatgataatcctgctcccagtgtgattgatggaaaccaacttttttgcattgctttcgcatttttaaatgcactattgaggcgatataaagagcctttaatatccggacgattggcaatggttgataatggaatatctaaatttacctccgcacttttgacttccaagatatgtggtgttttgatgtttaaatcttcattcggttttaagttaagcaaattacgcagggtagtttcggcacgttttttttgtgtttgataattaatcagattattacgagccttaagaattgattgttgtgattgatctgtacttgcccgatctgccataccttggttgaatttattttgcataattcgactaatttttgagtaataattaatcgtttggtttgttactgcaatggcatcatttaaataggcaagttgatagtaagttgtgacaactgagttgatcagagagagttttgttgcttgtaaatcttgttgcgtagcggaatgtgtccattttgcagcagaggttttatcggctaaacgttgccataaatctagggtgtagctaatattgagtgaaccgccgtgagtaattttagagttgctccctgtgttaatatttttggcggctgaagaattaacacctgtttggcgtgtgaaatttggtactaaatccgccgcaaccaaattggcattgtacagagccgtgtttactgcaatagtggctttggcaagatctttattattttccaaagcttgtttcaccagttggttaagcggctcgtcattatattgtgtccaccaattttcctgaatgttatattgttgagtcaatgcttcatattgctgaaaatcttgtaatgttgcatggtaactatcatcaatatttgcacaaccgattaatatattagacaccactattccaaacgtcattttagaaagttttaacataagttttccttatcttgtaagcagaaaagtgcggtctttttttccgcattttctgcaaattttatcatgtttttattcatgtgtcagagaggaaattgagtttaatttagatgcctttttgaaggtatatttactttaaaaaatggcttggtagttcctgatcacatacgattatgtcaaatttatctatcttatcaatataagctttttgaacttgatttatttttgatgaatcaattaccaaaatagcttgctcggttttctccattgctttttgttttgtttttacttcatcaaaattaaagcaagttacgcctttatttacatcaatccctgcagctgagatgaacgcttttgttgtgcaaattgcatccagttcattagttagctgaataggaattaaaaaagagttattctttgaataatttccaccgcacaaaatgacttcacaatgaggtttatcctgtagcaccataaaggtattaattgaacagcaaagtgcggtgaatttaatggcaggatcgatttgtgaggcgacgaaaggaattgttgaaccacagtcaaaaaaacacacatcgccgtctttaatgaaattagccgcaatgcgacccacttccattttttcggcaatatgctttgtttcttgctcaaaaatttggtagctgttatcggtgtttttttgtggatttttgacaatatagccaccaagtaaaacaactgagcctgtatctgaagccaaatcacggcgaattgtcatttccgatacatttaaaatagtggcagcatcacgcaagtgaattttatccatttgtttgagcaaaaagtctaatttttgaatgcgtgattgtattttcttatccataacaggctctattaattaaaacggttaataaatagcgttattgtctgttaaaccgttaataatagcaatccctgaacttgatccaattcttgtcgcaccatttttaatcatttcaattgcgattttagtatcacgcacaccacctgaagctttgacaccgatattttctccaaccacttgacgcattagtgcgatattttcaaccgttgcaccgcctttattgaaaccggttgatgttttaacaaatccgacccccagttcacgacaaattttacaagcagtgataatttcctctttggttaacaagcaagtttccaaaataactttaagtaaagcaccttcacaagcagctaaaaccgcttgaatgtctgcttttacggattcccactgatttgatttaatccaaccaatgttaatcaccatgtctatttccgttgcaccggcttttattgcttctttagcttcaaaagcttttacagtagataaattagcacctaatggaaatccaactactgtgcatattttaacatttgtattttgtaatttttgtcttgctagcggaatataacctgaattaatacaaacagaaaaaaaattatgttcaatcgcttcgttacaaagatccagtatatcctgttctgttttctccgcagttaatgctgtatggtcaatgaattgagcaatgtcataagattgcataaatatcctccttattttaggtttatgtgattattttcacttttttatatgatactgcaaaaaaaattaaaaactgtgactttaatcacttttttaacatttttaattttatatactgaataaaataaattttgtgagaattataacatttattacggagaaaaacattatggatattgcagtcattggctcaaatatggtggatttaattagctatattaatgatatgccgaaaatgggtgaaacgctagaagctcatgattttaaaatgggttgtggcggaaagggagcaaatcaagctattgcagccgctaaattaggtgcatcagtaatgatgatgactaaggttggtgatgatgtatttgcagataatactattaataatttcaagcaatatggtgtgaataccgattttgtcgaaaaagtggtgggtgtatcgagtggtgtagcccctatttttgttgatcgttcttcacaaaatcgcattttaattattaaaggtgcgaattcttacttgaaaccggcagatattgatcatgctgaagttcagttgaaaaactgcaagctgcttattttacaactggaaattcctttagaaacagtttattacgcaattgattttgccaataaacatcaaattccagtcattcttaatcctgctcctgcaagtaaggaattagacattagttatgcttgtaaatgtgatttctttatgccgaatgaaactgaattggaaattctaaccggtatgccagttgacaatatggaacagattcaagcagcagctaatagcttatttttgaaaggattaaaaaatctgattgtgactttaggcgaaaaaggatcggtttggtttcatcgggatcaggtaacacatgtctcctcgcacaaagttaatgctattgatactagtggtgctggagatgctttcattggttgttttgcacatttttatatacaaactaatgatgtcaaacaagcaatgcaaatggcatcagcctattcagcctatagtgtaaccggacaaggtacgcaatcttcttatccggataaagcacaattcgaacaatttctacaatcgttaaaataaggagtatggtatgaaaaatattcaacaaatgcccgatggttatctcaataaaacacctattttccaatttattttgctttcttgtttattcccactttggggagcagcagccagcttaaatgatattttaatcactcagtttaaaagtgtatttacgctgagtgattttgccagtgctttagtacaaagtgcattttatggaggatattttttaattgcgatacctgcatcattggtgatcaaaaaaaccagctataaaattgctattttaattggcttaatgctatatatcggtggttgttcactgttctatccagcctcgcatatggcaacatacacaatgtttttagtggctattttctctattgcgattgggttaagtttcttggaaacctctgcgaatacttatagttcaatgattggacataaagatcatgcaacattgagattaaatataagccagactttctatccagttggtgctatttcaggtattttattaggtaaatacctcatcttccaagaaggtgccagtcttgaagaacgaatggtaggaatgacaccggaacagttgcattcatttaaattatcaatgttagaacatacgttatcgccatataaatacttaatcttcatattgattgcggttacttttttattcgtaattacctcttttcctaaatgtaaagcagttacacaaacaggtaaatcagaagtgaaatttaccgatacgctaaaatatctagcaagtaatacaaaatttaaaaagggaattgttgctcaatttctctacgttggtatgcaagttgccgtatggtcatttactattcgtttggcactcaatttaagtgatatgaatgaacgtgaagcctcaaattttatggtttatagctttattggattctttattggcaaatttgtcgctaatttcttaatgactaaatttaagtcagatctcgttttactttggtattccattttaggtgtgatcactctagcttatacctcttttgttcatgatttttctgctgtttatgcggctattttcgccagtttgttgtttggtccttgctgggcaacaatctatgcttccgtactggatactgttaatcaagagcatagagaagtgggtggggctgttgtcgtcatgtctattatcggtgcagctgttgttcccgcaattcacggttatgtctcagatacattaggatctcttcaacttgcatttattgtacctttattctgttttgcttatgttggctattatttttatggaaaattaaaagaaaacaaggagaaatagtatgaaaagctacctttatttatctaaatcacaatttacagataaagaacaacttatttttaaaaatgaaaagctaagtgcggtcgcatttcaatatcaatccggtattgaggcggtcaaactgatcaatagtaaaggttttctaattgttttacctttttatgggcaaatcatttgggacgttcaatttaacggacaaactctcacaatgaaaaatatgttcaacgaacctaagcggggaacaactattattgatacctacgggtgttttgctttccattcaggcttaattcgtaatggttgcccaagtccaaaagacgagcatcctttgcatggtgaaatgccttgtgccgtaatggataaggcttggttgattattgaagatgacaaattagggattggtggtgaagttgaatatgtgaaaggtttcggtgagcattattcagctagaccggaggtgatattatctgctgacagtacattatttaatatcaatatggcagtgacaaaccttgccagtgttgatatgccgttacagtatatgtgtcatatgaattattgctatgaacatggtgcaacattcagccaaaatatccctgaaagtgcggtgcaattacgccaaactattccggctcatgtgaaaccgacaccgcaatggctatcgtttaatgaggagattaagaaagggaattatacactgtcatcgttggaaaatgatgaaatgtataatccggagatagtgttttttatggataatttgcaacaatatcagtcacaacttgaatatcgtatgcactccccgaaaggtcataattatttggtaaaattctcgtcagcacaattcaattatgcaacacgctggattttatataatgccgatcagcaagtgggtgcttttgtcttaccagcaacctgtcgtccggaaggatttttggcagctcaaaataatggctcattaattatgctaaaaccaaaagaaatgcggtattttagtgtcataacgggtattgaataacatatagcgaacaacataaatacggttgacaaaagtttaacggtattaccaaatgcatatttagttaaaatatcctaatgaaatgtttaaaaaaattggcttttataaaaatctcttgtataatcgccggaccctgtgaatgtgttggatttcccaccgcacattattttatcaagatcacactcgaaggggtggagattaagattgatggttgtgcttaagtttaataagcactgggtattaatattattttattggtaattaattaatgaaaacttttgtagcaaaaccggaaacggttaaacgtgactggtatgtagtggatgcgacaggtaaaactttaggtcgcttagcgactgagttagctcgtcgccttcgtggtaaacataaagctgagtatactccgcatgttgatacgggtgattatatcgttgttatcaatgcagaaaaagttgcagtaacaggtaataaagaaactgataaactttactactggcatactggctatgtaggtggtattaaacaagcgactttcaaagaaatgattgcacgccgtccggaagcagtgattgaaattgcagttaagggtatgttgccaaagggtccgttaggtcgagcaatgttccgtaaattaaaagtgtatgcaggttcagaacataaccatgcagcacaacaaccacaagttctagatatttaatcacgaggttaggaaaatggcagagaatcaaaactacggcacaggtcgccgcaaaagctcttcagctcgtgtatttatcaaaccgggcagtggtaaaattgttatcaaccaacgtgagttggacgtatatttcggtcgtgaaacatctcgtatgatcgtacgccaaccgttagaattggttgaattaactgataaattagatttatacgtcacagttaaaggtggtggtatttccggtcaagcgggtgcaatccgccatggtataactcgtgcattaattgagtatgatgaaacactacgtcctgcattacgtgcagctggttttgttactcgtgatgctcgccgtgttgaacgtaagaaaatcggcttacacaaagcacgtcgccgtccacaatactcaaaacgttaattttatatacaaaattgcaagccaaatggcttgcaattttttttcttattttgtcagtaaattatgatggaggcttatgcattgccttttcatttatggtaaaatgaaaagtctttattaattttcaagtcgtcggaggaaaagatgacaagtgctgcgaataaacgttcaataatgactctttttttagataaggttgatatttattgccatcaggttcgtattgttttagctgaaaaaggtgttgcttatgcaacagaaatagttgattctgaatctatatcagaagatttaatggaattaaatccctatggcacaattcctactttggtggatcgtgatttagttttattcaactctcgtatcattatggaatatttagatgagcgttttccgcaccctccattgatgccggtttatccggtttctcgtggtaaaagccgtttattaatgttacgtattgaacaagattggtatcctgtattagaaaaagcagaaaaaggttcagagagtgaaagagctattgcattgaaacaattaaaagaagaaatcttggcaatagcacctgtatttggccagtcactttattttatgagcgaagaattcagtttagttgattgctatattgcgccgttattatggcgaatgcagcaacttggtgttgtatttacaggcacaggcagtaaagcgataaaatcttatatggagcgagtgtttcaacgtgattcatttttacaatctgttggtgaaatgacacctaaaaatttaatggaggataaataggattaatatgtcgtataaatttttacctaaacgtccctatttattaagagcctattatgattggttgattgataacgacttaactccttatcttgttgtaaatgcaacttattcaggcgtaaaggttcctgttgagtatgtcaaagatggtcaaattgttttgaatttatctgcaaatgcgacaggtaatttattgctgaataatgaggcgattcagtttagtgctcgttttcagggggtatctagagatatttatattcctatgggagcggcattagctgtttatgcacgagaaaatggcgatggagtcatgtttgaaccggaagcattttatgatgaattaaatattgacagtgttgatgaacagcctttaggttttgctgaagcagttgatcaaaagaaagtgaaaaagactgaaacaaaaacccagaaaggaacatcacatttgcgtattgtgaaataaactaaagcaattttttgaaccgcacttaaagtgcggtttttttatgaaaagtaatttaatcaattcttgtatttagaaatttgcattacgaggtgtgcgagggaatgggattacgtcacgaatattttgcacgcctgtaacataaacaattaaacgctcaaaacctaatccaaaacctgcatgtggaaccgttccataacggcgtaaatcacgataccaccaataatcttcagcttttagtcccatttctgctatgcgtttgtcaagcacttctaaacgttcttcgcgttgagaaccgccgataatttcaccaattccgggggccagaacatccattgcagcgactgttttaccatcatcattcaaacgcatatagaaagcttttatatctttaggatagtttttaactacaaccggcgatttgaagtattcttcggctaaataacgctcatgctcagaagataaatcaattccccaagatacaggaaattcaaacgctttgccggattttaacagaatatcaatcgcatcagtatagtctatttgagcaaagtctgaattgatgaaatcttttaagcgagtaatcacatttttatcaacatgcttttcaaagaattttaagtcatcttcacgttcatttaatactgcacggaaaacatatttcagcatatcttctgctaattttgcattgtcagctaaagttgcaaaagcaatttcaggttcaaccatccaaaattcagctaaatgacgcgttgtatttgaattttctgcacggaatgtcggaccaaaagtatagattttgcttaatgcacaagcataactttcaccatttaattgacccgataccgttagaaaagactctttaccaaaaaaatcttggctaaaatcaaccgcacctttatctgtgcgaggcagattttctaggtccaaagttgatacacggaacatctcaccggcaccttcagtatcagaagctgtgatcaagggtgttgctacccagtagaaaccttgttcatggaaaaaacgatgaatagcttgagctaagcaatgacgaacacgagctactgcaccaatgatattagtgcgtggacgcaagtgtgccacttcacgtaaatattcgatactatggcgttttgcagacattggataagtttcaggatcatcaacccaaccggaaacttcaattttatcggcttgtaattcaacagcttgtccttcagcaggagactcgacaatttttccagtgacaacaacggaacaaccggtagttaaacgtaaaatttccgtttcatagttttcaatatcattatttacaatagcttggataggatcaaagcaagaaccatcgtaaatagctaagaaagatagtcctgctttagaatcccggcgagtgcgaatccaaccacgtactgttacagtttcaccgaccgtgatttttccttttagaatattagccacagatgcaatttttgtcatataaacctcaaatcagtttttataattgtaaaacttagtcattttaccgtaactcattaaaattaccaaaatgtatcggaactttttgtttttgtgagatagcacacataatttatataagtcccttgtttattaggaaaatttcttggtataaatgaacaattttatgaattaaaataatcaggtagaacaggtagaaaatatggcaaaagtgagaaaagaggataaattacctctgagaatgaagcagctaggcaaaatttatcgcttaattgaacaatttgaagaaatttcacgtattgatttatccaagttatctcaactggctcctgcaactatcacctccttaactagagaacttatagaaaaaaaattggtgattgaaagagcggtacaaaatacggaaaatcgtggtcgtccggcagttggattatgtgtctcaccattttactggcaatctctttgtgcaacactgacatacgatcattttgatattttgctatgtgagctggatggcacaacaatagcccaagaagtttatcctcttgatctttctgatttatcttcattagaacaaatgttgccttgctattttgaagattttttatcaaaagttgggactaaattgagtcgtccgattactttttctattgcagtggcgggtaaactacaccatttgtctggttttctgcaacgtttgggggagatcgaattaaatgtggatctaacatctttatttgcaggctattttgatataccgattattgtaacggaatattttgaaacttggttattggcggaaagcacattaggaagcgtgataggatacgatgatgtgattttcttacaaattgatgaagtcattaatttgagtgttttatcaaaaggggttattctacaaagtaaccataacgcttgtatgaatattgacmaaattattgttcctcgcctttacccaatgcaagataagatcaatcaacatttatctgaacttgagcgatatcaaatacataatcaattgacttataaagcattttgtcaatttatagatctgtattatccaaataataatttaattaacacgacagaaaagatcaattttttatgtaaaaaagcacagcttcaagatcctttagcattagaaattttagctaacatagccgatattattgcatacatcttatccaatttagttaatcttttttcacctgagaaaattatgtttacttctcgtttgctatccgtcaaacatgttttccttaatcaaataaatcagcgtttagcacattatttgcataattcaaaaatatgtgaagtaatgacgagccagtatgaatggaatagtcatgaagttattgctgctgctattaaacaaaagatttatgatggtagtttgttagtttatatggaaaagtattaaaattttcttcacttagctgtcaaaaaggcgttagaaagcatttttgattggtcgactataaataaaggtttcagctgaaagtatcatagcaaggcttttaacttttaagagttaaaggcttttggggtagcgaatttacgcccccagctcttttgaaatggattgtgctgtttgtttgagatgcatgagcaatatatctttgccgatttggtttaaacgtgcagttgatagagaaattgatacggagtagattacattgctattgatgtcaaatatcgggcaagctaaacaagttacgcctgtttcattttcttcattatctacggcataccctaattctcgaatcttatttaactccagctccatagcactcagtgttacaattgtattagctgttaattttgtaatattcgtttgatttttctcccaataatcatctagaatgtgtcttttttcgtatgccataaaaatttttcccatagctgaacaataaagttctaaacgctgaccaatatacgctcgtgtacgcatcatacctgttgttggttcaagtttataaatcattacagcatgatgatgatcacgcatagataaattgactgtttcacctgtattcaaattaagttgctctaagtaaggggatgtaatatttaatatattaagtgaactcaaggttttttgcccaatcgttaaacacttcattgttaaacgatatgtaccaattgtattggtaggtttgacataaccacaggtttgtagtgtttgtagcatacgatatgttgtacttttatttagattagataattcagctagtttagctaatggacaaccattagggaaattgctcaaaatatcaattagtaataaacccttaattaaactttggttgctgctagcttgtttatttttattctcttctttcattttttattcctaaatagcttttttggttagttttattttagtgatatatcgataaaataaaaatgagatcttgatcacaaaaaataaaaaaatttatatctatatgatttataaaaacttttatttcttattttcatttgcatacaaattttattcagactataattttttaaaatatcgtttcaatatatgaaataaagattggcgtaatgaggttaaaacatgaaagtcagctacgaaatactcaaacaagaatttaaacgtatattacttgcaagaaatgttcgtgaagacattgctgaagaatgtgcgactatatttgcagatacaactgagtcaggagtatattctcatggggtgaaccggtttcctcgttttatttctcaactggaaaaaggagatattgtaccggaagcgattccgactaaagttctttctttaggtgcgattgaacaatgggatgctcatcaagcgattggtaatatcacggcaaaaaaaatgatggatcgagccatggaaattgcggatcaatttggcattggcgttgtagctcttaaaaatgcaaaccattggatgcgaggcggtgactacggttggcaagcagctgaaaaaggttatataggaatttgctggactaattcaattgcagtcatgccgccatggggagcaaaagaatgtcgtattggtactaatccattgattattgctgtaccgaccaaccctataacaatggttgatatgtcttgttctatgtattcttacggtatgttagaagttcatcgtttagcgggtcaacaaacatttgttgatgccggatttgatgatgaaggtaatttaactcgtgatcccggtactgttgaaaaaaatcgtcgcttattacctatgggattttggaaaggatcaggtttatctattgttctagatatgattgcaaccatactatctaatggtttatctgttgcagaagttaccgaagaaaaagatgatgaatattgtgtttcacaaatcttcattgctattgaagtagatcgtttaattgatggtaaaacaaaagatgagaaacttaataaaatcatggactatgtgaaaacagctgaacgagtagatgctgatgttgcaatacgcctaccgggtcataaatttgcggcagttcgtgctgaaaataaaattcatggtattccggtcgatgattctgtttgggaaaaaattaaatccctataacctataaggaatacttgttctctggtcattgttttgatcaataatcaactaaacccgtaaagttgttattaaaattacggtaaatgtgaattagaggtagcatgatgagatcgattagtttaaccgtaactaaactattagaagcattggttgttattattttagcaacgatgtcttgcttggtattccttaatgtcgtactacgctatggctttaatagcagtatcaatattacagaagaagtttcacgctacttatttgtttggttggcatttcttggtgctatcttagcctttaacgaaaatcgtcatgttaatgttacgatttttatcgagcgtttatctcagcatcagcgaaattttctacgcttattaacggacagcctaatgttgttttgctgttatcttttaattacaggtggctggatacaatttcagcttaatctaactaatatggcacctatttctggtatcccaacaggtattacttatttagctagttttattacaggcttagttattgccatactacttatcattcgacttttttctaatgctggtgctttgataaaaggagaaaacaaatgacggttattatctttctttccactttattaggaggtattttattaggtattcctgtcgccttttctctgttattgtgcggtatagcattaatgttgtatttagacttatttgatgcacaaattttggcacaacaaatcgtgagtggtgcagatagtttttctttaatggcaattccattctttatcttagctggtgaaattatgaatgaagggggattatcaaaacggattattgatttgccgatgaaattagtaggacataaatgtggaggattaggttttgttgcaattcttgcagcgatgattatggcgagtttgtcaggttcggctgttgcggataccgctgcggtggcagcgatgctattacctatgatgaaaacaacaggttatccgctggatcgttcggctggtttgattggtacggctggtattattgcacctattatcccgccttctattccgtttattatctttggagtctctagtggtgtgtctattactaagctgtttctagcgggaattgtaccgggaatcctaatgggaatttgtttagctgccctatggtggtggcaagcaaagcaccttcgcttaatgactttttccaaggcaagaaaagaagaactttgtgcttcctttaaaaatagtatttgggcattaatgttacctgtaatcattattggtggtttccgttctggtatttttaccccaacagaagcaggtgctgttgcagcattttatgcattatttgtcgcactctttgtatataaggaattgaaaatcaagcaactttatcaagtttttctcgcagcggcaaaaacaactgcggtagttatgtttctcgttgctgctgctcaagttacaggttggttaatcacgattgctgaattaccacatatgatgacagcattgttagagccactaattgatacaccaactttattacttattgtcgtaatgctatttgtttttttgattggtatggtgatggatcttacgcctactgtattaattctcacaccggtattaatgccattggttgaggaagcaggaattaaccctatctattttggtgtgctctttattttgaatacttcaattggtttaattacgccaccggtaggtaatgtccttaatgtcattacaggtgtatctaaattgccatttgatcaagtgacaaagggcatacttccttatttattgatgatgattgtgttgctctttatctttattttcttccctgctttaattttaatgccacttaattggttacaactttaaatcttcataggagaacattatgacactattaaattttaaaacgctttctgtgttaatcgctagcatagctctattctcaggtaataccaatgctgcaacgacattacgttttggttatgaagctcctcgtggtgatacacaacatgaagcagcgaagaaatttaatgaccttttaaaggaaaaaacaaaaggagaaattaagttaacactttttccagacagtacgttaggtaacgcacaaactatgatcagtgctgtacgtggtggaacgattgacttggaaatgtcaggttctccaaatttttctggattagtaccaaaattaaatgtgattgatattccattcattttccaaaaccgcgagcatgtatatgccgtattggatagtgaaattggtcaaagtttattaaaagaattagaagccaaaggattaaaaggtttagctttttgggaagtaggatttcgatcttttactaactcaaaacatcctgtaaaatcccctgatgatattaaagggttaaaagtgcggactaaccaaaatccaatgtatattcaagcattttcaatcttaggggcaaatccagttccaatgccattatccgaactttataccgcacttgaaacacgtgcggtagatgctcaagaacatcctgttggtatcgtttggtcagccaaattatatgaggtgcaaaaatacttaagcttaactaaccatggttatacgccattgattgttgttatgaacaaagccaaattcgatgccctgtctccggcattgcaaacagcattagtcgaagctgcacaagaagcaggtgcttatcaacgccagcttaaccttagaaatgaaaaaagcattattgaaaaaatgcaaaaagcgggcgttgaaattattgagcgtgttgataccggaccgtttagggcagccattgaaaacgaagtacgcaaggcattcattgagaaaaatggtgatgatttagttaaaaaaattgatgcattagcaaaataagtatattcaatgataagaaacagaatttttattaaattgaccgcacttttacttattccttattcggaaggaggagcttatgttggcaaatggagacgttccaattcttcagctacagcatatcatcaaacgattcggtaatcaggtagcggtaaatgatgttagccttaatattcaccaaggagaaattgttgcattgctcggtgagaatggtgcgggcaaatccactttaattaaaattctggcaggtatctattctcgtgatgaaggtgaaatttattttcatcaacaaaaaatccaatcggcacaatctcttaccaataaaaataaacaacctattgcttttattcatcaagatttagggctggttgaatggatgacgattgctgaaaatatggcatttgtaatgggatttcctcgccgtttcggcttgattgattggaaaaaaattaatcaacaagcacaagaagcattggattttgttggtattcacctttctgctcaaactcgagtttttgacttaagtcgtacagaaaaagcgttattgaccattgctcgtgcgattgctgtcaatgctgagattttagtgttggatgaaccaactgcctctctacctgcaggtgatgttgaacatttattcaaggtgcttaatcgcctacgtaaacagggcgttggtatgatttatgtcactcaccgattggatgaggtcattaggctttctgatcgcattttagtcatgcgtgatggttattctgtggcagaaggttcgactaaagattatgatgtgaaagctctagtgaaggctattgttggtgaagaaacaagagaaaaacaacgtgaaccattgcctaaaaacacaccagaagtggtacggcttaacgaagttgttgttggtgataccggtcctgtttcctttagtttacatcagggcgaaatgattgcattagcaggattgcgaggtgcgggacaagaagagataggacgattattatttggactacgtaagttggaaagtggagacattagtttaaatgaatgtgcttatcatgccgagtcgccatgtgaggcaatttataaaggcgtagcacttgttgccggagaccgtatccgagaaggtcttgtcatgtcaatgacaaccatggaaaatctctttatcaatcctatcttaaacggtcattttccattaaaaaattatgcaagcaaaaaagaaaggtctgaatgttggtatcaattccagctctttgatattcggccgaaaaatttatttattgaggtcagttcgctttcaggaggtaatcaacagaaaattgtgcttgcacgttggatgcagctcaatacacctgtgctgattttagaagatccaactgcgggtgtagacgttggtgcacgagcagaaatttatgacttattaaatcaagccttgaaaaaaggtgttgcaattattgtgatttcaaacgattttgaagaaattgcacatctttgtaatcgagccttggtattcaaccgaggcgatatcgtgggtgaattattcaatgaacaagtcacatttgcgaatttgctggcactcgcttcggacgcatctgctaccataaattaatttttgtgtttttagaccgcacttaaacaataggagagcatcatggctcaaacaaatattaaatcaaccgctttagaacaggctgtatctattgcacgtgatgggttttgggcgtgggtttctcaaatgatcactcgatatgggttactctgcttatgttttttacttatcatacttttctctatgacaacagattcttttgcctctatgctaaccttacatgcgattttagaaagtaaatcaaaaattgcactattggcactcgcagcgacgacgaccatgattgtaggcaaaattgacttaaatgtaggctttggtattgttctttggcatattttagctattacactacaagttcaattcggtttttcatggcaaatggcgactatcacagtactcattgtggcagcaatttatggcttacttaatgggattttagttgcacttgctgacattgatagcttcgtcgctacattgggaacgggaacggtattgtatgcaattgctttatggcattcaggcggtcgccaaattgtcggtgatttacctgatgcttttattgctattaacagtactgagatcttaggtattcctatctcggctttttatgtgttaatcgttgctattgtcatgtggctggtgactgaacacaccccaacaggacgttgtatgtatgctgtaggaggaaatcctaccgccgcttatttgaatggtatttcgattaagaaatatacgattgtgccatttattgtatctagtttaatcacagggtttaccggagttctcatcgcagcacaacagggtgttgggcaagcaagtgtcggaatggattatcttttacccgcactggtaggtgcgttcttaggcagcacaacaattaaaccgggtcggattaatgtttggggaacccttgttggaattgctattctcgctattggtatttccggtattcaacaattcggtggtgccttttgggtcgagccattatttaatggtgcaactttattattatctatcactatcgcaggttatgcacaacgtaaacgtttattaggtcaaaaagcagtacacaagaaagcagcaacaaaataatttgttgtgttaattacccactaaaaggagaaaatttatgaaacagttttttcattgtagtttaagtgtagtggcttctgtagtcgcactctcttttgccggcaacactatggcaaatgatccatttgtcgctgaagcaaaacaacaagttgctacagctactgctcaaaaaacaacttgggatggaccaacaacaggtccaaaagtacaacaaggaaaaaatattattttcattgcttctgatatgaaaaatggcggtgtattaggtgtaattgatggtatgaaagaggcaactggtgtagttgattggaaattagaggtacttgatggtgcgggatcagtcaataatcaactttctgctttaaaccaagcgattgctcgtaaacctgatgccattgtcattggtgggtggaatccaaatgtggcaaaaattccacttagtaaggcaactaaaaatggaatcacattggttgcatggcatgctacaccggaaccggggccaataaataaatataatattttctataatgtcacctctgattctgaccaaattgctaaactttcagctcaacttgctgtagcaaactcagatggaaaagcaaaagtggttattcttaccgattcactatatgaaattgcgttacgtaaagcgaatgtgatgaaagaaattattgaacaatgtaaagaatgtcaggtattagagttcattgatacgccgcttgcagatacctcaagtcgtatgccgagcctaacttttagtttattacaaaaatatggtgataacttacaatacacacttgctattaacgatctctattttgattttatgacaccgtccttacgttctgcaaacaaaggagaaatgccatacaacatttctgcaggagatggttcagttactgcctatcaacgtattcggaataataatcatcaatttgctaccgtaccggaacccctgaatttacatggttggcaattagtggatgaacttaatcgtgcttttgctggagaaaaaccctctggttatgtcactcctgctcacctagtgattaaagacaacgtggcatttgatggtgggaataagaacctttatgatccacaaaatggttataaagaagcctataaggcgatttggaacgtgaagtaatcaactattgtggtcgcaaaaaattgtcaaaaaagaccgcactttcctagtaaggagagtatatgttatcagctaaaattgaagtttatgattcacgcttttaccaattagttggcactgaagctagattagaagaattgtttgacaaagcgatttgggcagagggacctgtttggctagaaaaacagcaagctgttatatttagtgatgtcaaaggcaatacaatgtatcgctggacggctgaacaaggtacacaaatattccgacaaccatcacaatttgccaatggtaatgctgtggatgctgcaggtaatttgattacttgtgaacacggtcgtcgagctattagcttaacggatcatgcaggtaatattcgagtgttggtcaataaattagaaggtaagcgactaaattcacctaatgatgtagttgtgaaatctgatggaacaatttggtttacagatccaccttacggtattttaagtgatgcagagggcaaaaaatcgcctagtgaaataattggctgttatgtatattgctatgatcctataactgacgatatccatatcgcaacttttaatgtcatgcgaccaaatggtttagctttctgtgaaaatgaaactaagctagtggtagcagatatgtcagtagtcgagtttcaaagaacaggcttacaccatcttgtagtgtttgatgttattgataatcagttatataaccgtacaagcattgctgctatttcgccaggtattcctgatggattctgtattgatcacaacaatgtgatttattgtagctgtgaaacaggactactggttttgttacttgatgggacttttttaggaagaattttactagataaaaccgcttctaattgtacctttggtttagatcaaaaaaccttgtttattacagctactaatagtttgtattgtttaacctttaaataaaaagagccggtaaggattatagaaaataatcattaccggcttttagctttatatatttattgaggattaataattttgtttagctttagcctggtcaaccactacaggatcaatataataaacctcggggatatcttgcttattaatttgtttaattgcatgttcaattgcgacagcaacttgttttttcggtaattgatcaattgtattttgcattttgccttgtttaacgtattcaatagcgagaggaataccatcatagccagttataagcactttgcctgctaatcctgcattttcaaccgcagtaactgcacctattgccatattatcatttgctgcaaaaataccttgaatgttagggttagcagttaagatgttagtggttacatttaaagcctgttctgtttcccagttcgcagattgtgaagcaacaattttgatatcaggatattcagagaatgcttttaaagctccggctttacgttgttctccattatcgacaccaggaatcccctcaagtatggcaatatttccttttttacctatcgcttctgcaaggtttttagcttctaaataacccccattaaaattatctacgccaacatagttaaaatttaatccagcttttttagctgcttctgcatcaagtcttacatctaaatcaataattggaatccctgctttttgggccttttggaaagcagggataaaggcaatagaatcatttggtgtaacaataattgcatctactttttttgcgatcatattttcaactaatccaacaagttgttcagttgagtcttctttttccgcaacttgaattgtcaaatctacatttagttgtttagcagtttctttagcaccctgttgcatagaaatgaaatattcattgcttagtgttttcatcaataatgcaatttgaggtttttctgctgcaaaaagagaggtagaaatagccaatgtacttgttataagcattgctttgaatagtttagatttcataattgatctccagtgaatttgtagttaaaaattggtagcaatcctaaaataaaacttgtctaaaaactgtgatctagttctcaaaataaataaaactttaaaagtctattttctcagcttttaagtttatttactttgtgtgatacctatcacgattttattagtatttttatgttattcttaatatacagattgataaaaagggataattgctgtgttagatactttacctattctgtcacttagaaatattagtaaaaatttctatgacgtagcggttttagacaaaattaatcttgatatatattcaggcgaagtgcattgtttaattggagaaaatggagcaggaaaatctacgttatgcaagattatcgctggcatctataattcagatggtggcgaaatgttttttcatggtaaaatttattctcctcgtaatgtaaaagacggtcaaaaatatggagttggttttattcatcaggaactaatgctagtacctcaacttactgtactggaaaatatttttttaggaaaagaacatgcgaatttaggaaatcgcatggactggaaaataatgagagagaaaacactaaaaattattcgtgaattagaactcgatatacagccggatgatttagtatcagatctttcgattgcacaacaacaaatggttgaaattgctaaagctatttttagtgaatataaagtattaatttttgatgaacctacttcttctatatctcgtaaaaatacagaaactctttttagaattattcaccggttaaaagaaaaaggtgtagcgatgatttatatttctcaccgtttagaagagtttcaatatatttcagataaagttacagtattacgagacggaaatattactggcacgatgttgtataaagaaacatctgtagaagaaattgtcagattgatggttggtcgagaaattaatttaggacattatcaaagagatacaatatttacacaggaaaaattatgtgttgaaaatattactaataaaaaaattaaatcagcttcttttactgtgcataaaggagaaatattaggatttgcaggtttggttggagcaggtagaacagaacttttaagagcaatttatggagcggatgatgctaaaggaaatatttttatagataagttaaaagtttgcattagatcaccggaacaagccgtaaaacataaaattggatttattacagaggatcgtaaactacaaggtctcatattagatcagagtattcggaagaatataacattaccaatattaaatcgtttctggacaggaattagattagatcaagaaaaagaaaaaaatgtagcagagactcaacgtgatcgcttgagaatcgtgtctaacagtggtgaacagcacactagaactctttcaggaggaaatcagcaaaaggttgtaattgctcgatggttagaaagtggtgtggatattttattttttgatgagcctacaagaggaattgatgttggtgctaaatctgagatttatgacttgatgagagaatttacagacaacggcggtactatcattatggtatcgtctgatttacctgaattaatcacaatgtcagatagggtaatggtcatgaggaatggtgaaattgtagaagaagttaaagatcgttctagaattactgaagaaaacctaatgaaagctatggttggtgtatgaggtctaaaatggataacttaaaattaattttttcaaaattaggaattggtattgcattaattgtaatgattattggaatgtcatttgcatctgatgcatttttatcagctcataatattctaaatattttattacaagtttcagttatatgtattattgctgtaggtatgacttatgttattttaactggagggatagatctttctgtaggttctatcgttgcactaagtgccgtatgcttaggattatttactcatctaggtcttaagtggttaggcgatgaagtatcagattttgccgtattagcggtggttttaattgctatattagggagcgttttagttggtgcactatgtggatatataaatggaattatcattgtgtatggtaaagttacttcatttattgcaacacttggtatgatggggattgctaggggattggcactaacgatatcagatggaaaaacaatttataactttcctgatgctctgcgtttttttggtaatggaagaatacctatttcagattcgttttctatacctatcccagtaatcattgctattttggttgtgttggttagtttttatgtgctaacgcaaacgatttttggtcgtcaaatttatgctttaggtggaaatcgagaggcggttcgtttgtctggtgtaaatgttgagaaattagaagtcaaaacatatgcaattaatggggcattggctgcagtaggtgcggtaattttagtaggacgtttgaatgcggcacaacctatcgcaggtacakgttatgaattagatgctattgctgcaactgttattggtggtacaagtttgatgggtggttttggttcagttattggaacttcaatcggtgcattaattatgggagtactgcaaaatggtctgactttattagatgtgacgtcttatttacaacgcctaattattggtgttgttattattctagcagtattttttgaccaattacggcgtggtaaagtttcaataggacaattaaagcgtattttctttagagaataacttagaagatagtctaaatagttaataattttaattattggtatgcacagttatttgaataaatatattgcttgctgaaatttaggataaggaatagtgaaatgaattacacacttggtattgactgtggaggcacttttatcaaggctgcactctttgatacttttggaaaaatgattggttgcgtgcgtgaaaatgttgatgtgattagcgagcaagccggctatgccgaacgtgatatgtatgaattatggcaagtttgtgcaagtgtgattcgtaagacaattgaacatagccaaattgaacctagtaatatcaaaggtgtgggcatttctgcacaaggtaaaggtgcttttttattagataagaatcatcgacctcttgggcgtgcgattttatcttcagatcaacgttcacttgatatcgtgaaacaatggcaagctgatggtattcctgaacaactttatccaataactcgccagactttatggacaggtcatcccgtctcaattttgcgttgggtaaaagaacaccagccaaaacgttatgaggaaataggtgcggtattaatgtctcacgattatttgcgtttttgcttaacaggaaagcttttttgtgaagaaacaaatatttctgaatctaacttatataatatacttacaaggcaatatgatcctgccttggctgatttactaggtttatcaggcattattgataaacttccgcctattattgagtccaatcaaattgcaggctatatcacgcctgaagcggctactttaactggtttatgtgttggtacagttgtggttggcggattatttgatgttgtttcaaccgcactttgtgcagatttggatgatgaaactaaacttaatgctgtattaggcacttggtcagtgataagtgggatcactgatggtattgacgataatcaaacacttccttttgtttatggacgctatgcacaatctgagaaattaattattcatgaagccagtccaacttcagcaggtaatttagaatggtttgtgaagcaatggcagcttgattatcaacaaattaatcaacttatcggggagcttgaacctgctaccagttcagttttatttgttccatttttgtatggttcaaatgcaggattaggtatgcaagctggcttttatggtctccaagcacatcatacacaagctcatttattgcaagcaatttatgaaggagtactatttagtttaatgcatcatcttaatcggatgttacaacgctttccaaatgtgaagttattacgtgttacaggtggtccgacaaaatctaaaatctggttacagatgcttgctgatctcacaggaatgaaactggaagtaccacaaattgaagaaacgggatgttttggagctgcattgatggcgaagcagggttctagtgagtcaaccactgatgttttccaaacgcaaactatgttcagtgttgagcctaatcctatttatttcacagcatatcaaagaaaatatcaacgttatcaaaaacttatagattcgttaaaagcaatgatttaatgaggaaaaaatgacaaagccacttattcaacttgcactagatgaaacagatttaaacaccgcacttgttactgctaagcaagtagcagactcggttgatgttattgaagtaggcactattcttgcttttgcagaaggtatgggagcagtacgtatgttacgagcacgatatccaaagcatattttagtttgcgatatgaaaacaacagatgcgggtggtattttagctgaaatggcatttaacgcaggtgctgactggattactgtttctgctgcagctcatattgcaacaattgagagttgtaagaaaatagctgattactatcaaaaagaaattcaaatcgaaatctatggcaattggacattcgatgatgctcaagcttgggtcgatttaggtatcaatcaggctatttatcaccgtgcacgtgatgcggaaatagcaggtaaaggctggacggaagatgacttagtaacaatgaaaaaattatcaaaaatgggattatcgctctcaattacaggtggaattgtgcctgaaaatatctatttatttaaagatatcaatgctaaagcatttattgccggacgggcttttacaggtgaaaaaggaaaatttactgtagaaaaaatgcggttagaaattgataaatattggtcctaatattgcagagataaacatggagtatattgtgagaacacataaaatcggtatttatgagaaagcattacctaagaacctaagttggcaagaccgtttatccattgcaaaagcatgtggctttgattttgtcgaaatctcaatagatgaaacagatgaacgtttagcacgattagattggagtaaagctgagcgtattgaattagtaactgctattatttcaacgggcattactatcccatctatgtgcttatcaggtcatcgtcgctttccatttggtagccgggatgaagcaactcgccaaaaagcctttgagatcatgaaaaaagcaattcagcttgctgttgatcttggtattcgaactattcaattagctggttatgatgtgtactatgaagaacaagatgaaggaacaattcaacgcttccagcagggattggaatgggctgttaaacttgcggcaagtcaccaagttaccattgctgttgaaattatggatacacaatttattagctcaatcagtcgttggaaaaagtgggataatataatccgctcaccgtggttcacagtttatcccgatttaggtaatctttctgcttggaatgaaaatgtgagtgaagaactcaaattaggcattgataaaatatcagcaatccacttaaaagatacttataaagtgacaactactagcaaagggcaattccgtgatgtacctttcggtgcgggttgtgtagattttgtacaatgttttcgtaccttatctgaattaaattatcgtggtgcatttttagttgaaatgtggacagaaaaagcagaagaaccaatcacagaaattattaatgcacgtcgttggattgaacaaaaaatgaaagagggtggttttcaatgttagaacaattaaagcaaaaagtatttgaagcaaatttagcgttacctaaatatcatttagtgacatttacttggggtaatgtaagcggtattgatcgtgaaaaaaatctagttgtgattaaaccttccggagtggaatatgaggtaatgacgcctgaagatatggtagttgtggatttattcacaggtcgagtagtggagggcaataaaaagccttcatctgatactgctacccatctaatactttaccgtgaatttccaacacttggtggtatcgttcatactcattctcgtcatgctactatatgggcacaagctggggaagatttgattgctgcaggcacaacccacgcagattatttttatggtgctattccttgtacacgcaaaatgacacctgtagaaattcagggtgactatgaacttgaaacagggaaggtaattgtagaaacatttcgtgtacgagggattgatcctaaagatgtgcctgcggtattagttcattcacatggtccttttgcatggggaaatgatccggataatgccgtacacaatgctgttgttttagaagagattggctatatgaatttatttagtcgccaacttcgtcctaatttatcttcgatgcaacaagaattgctggataagcattacttacgtaaacatggtaagaatgcttattacggacagtaaatatgacataagtgctaaagtaaattgctttagcactgagttttagatgttattaagaatagcgtctaagacagaagcaattcccgctttatcatggtgtagagtgatcaggtttgcttgttgtttaatttcgtcctctgcattacccattgcgacacccagtccaactaatttaagcatagaaatatcattatggttatccccaaaagccacaacaaattgagggtcaatgtgccatgtgtttagtaactccaataatcttgagccttttgtatttccgctattggcaatatcaacacgatcaacccatgaccactcacaactaaacccaattgaagataaatgattaaccgcagtttgcatcaacgcacgatcaggatggctaattacaaatttccatatcgtttcctgatcatttaataacacattaaaatcaggaacatggcgtagtttgggatgtacttggggaggacaacgctgtacccattcggaaaatttacgcagatgctcattcattattgagtaattcattgtatcacgtgaatacattaataaatgtaaattgtatttttctgccagttgaatgacttgtcgggattgttctaaagagagaggatttgctgcaagtacggtatctgtttgtggttgatacatataggtaccgttacaacaaatcatgggagtagttaaattcagctcatggtaataaggataggcggcagtatgatgccttcccgtgactaaaatgacttttaagcctttatcaatacaacgttgaatcatgattttatttgacgttaaaatttgcccttggctatttaacaacgtgccatcaagatcaaacgcaatgacttggtatttcatcttttttcctattttgaatatcatctaattggtaaagtatagagctttttaagtccaaagggaatatattagtctttgcagggataggacaactgtataattctgtataggaaaattaaataaaactgaccgcacttttatgctcaccttataccgttacgatgcaattattttcaataagtacaatgatgaaatgtgttatgattaacacatttccagttttgatgtagagtaaattatgagtcaacatgaatctcacttcaatcattttgccttagccgaactgtatccttttgctacacaatttcctttgcaaaatataataggaaaaaaaggcatgcgaatcgtctatcgccattttgttcaagaacattgtgctgaacgtagattagtgattttggtcaatggacgtgcagaaaacttgttgaaatggacagagttggcttataacttttatcgacaaggctatgatgttttagtgtttgatcatcgtggacaaggctattctcagcgtttattaaaagagcatgacaaaggctatattgatgagtttcgtttttatgcggatgatcttactttgttagtggaaaaaattacttcgttgtatcactatcgtagccaacatattttggcacattctttaggcgctttaatcagcacttattatcttgccaatgataatcaccaaataaaaagtgcggtattttctgcaccattttatggtattccactgcagcattcattacgagatgaattcattattaatttaatgatgttgcttgggcagggctcacgctatgtatttggcaaaggtgagtataaacccgctgatttagataagaatgatttgagtctttgtcgtactagaatgaaatggatgaatcgtattaatcgtcgatacccacatattcatttaggcggaccaacttttcgttgggcatatgagtgtatgtatgccattaaaaaattacccgttgtcttaccccgaattgaaattccggtactagttttacaatcagaaagagaaaaaattgtggataaccaaaatctgcaaaaattgaccgcacttttgcctcaagctcaactagtgcagattgaacatagtaggcatgagattttatttgaacgtgatcgaattcgagacttagcactagcaaaaatcaatcagttttttactgaaaataacgccaaataaacacgcctaatgttgtaaaaaacaagcaaccgagaatatgtaacgatgtaatagttatgccttctagccatttatgttgaagcagattttcaataacttctgcactgaatgccgaaaatgttgttaaactacctaaaaatccagttacaaaaaataggcgatattcagttgaaaaagcagacgaatgccaaaacatagccagcattattcccataattaaacaaccgatataatttgcgattaatgtgccaaaggacaagaaagtaaacaacggattgagtaataatgtcaatccatgacgagacattgcaccaagagaagcaccacagctaattaagaataaatgtgtaaatagattcatatgtgtataataaacagaattaaatgatgttaaatagcgtgcagagatacctcgctaccgattcttgtgcgtttaacccaatgatttctaaattcgggcaagttgactttaaacgtggatcagcattactcatcacacaacctttaccaactttggttaacatttgtatatcattcataccatctccaaaagcaatacattgctgcattccataattccgctcggctaatacctgctctagtgcagtggcttttgatacattttgattcattatttctaaacaaacgggagttgaataagtaatgctgagtttgtctccatatgtggttttgagagatgtttcgatattgactaagtcttgcggttcccggccaaggaaaaacactttttctgtagtttttccatgatgttgagcaaaattcactactttatacataaaaccggaatcttgatggtatttacgcaactgaggaacttctgtattaataaaccaatcatccccttgatatgaattaacacatacatgtgtacgatcaaaaggtaagttcataatttcaaatgctattgtttcaggaatgtaattgcggactaaaagattgccttgcaaatcctgtgctcttgcaccgttagaagtaatcattactgcatttttgatcttaattttttttaagattggtagcaaatccgtatggttacgccctgttgctaagataatatctataccttgagatgcaagcttttgtagtgtctcgatagtgaaatcgccaatcatatgattggcattaagtaatgtaccgtctaaatcagagacgatggcacgaaaaggaacattttgcatagcctatctttatcctatactgaaatcacagaacagattatttaacccaagtgacgatttcatcaagggatttacgggattttggcttaatttcttttgctcggtagccgaaagttgccattaccgaaactccccattcgtctgaatctaatacacctgcgtcagttaaaatttgatttactttttcataattaaaaccttcaattggacaactgtctattccaattaatgcagcaccagttaacatatttgctaaggcaatataggtttgtttacttgcccagtcaaataaagtgcggtcattctcaagcgttttcatatgttctgcttgaaagagatgatatttttctttggtagcttgtatttgttcgccggataacccacgtcttttcatggattgtactaaaaattctgaatcatagcgtgcattctttttcgctaagataacaactaaatgactggcatcgtcaatttgagttgccattccccagctgacaggttttaattttgcccgtagttccggattttggattactaaaaaatgccaaggttcagagccgacagaacttggcgaaaggcgagcaaattccaaaacataagagaaatcttcatcgctgatttttttatttggatcatagtaacgtgtggatgcacgacgattaaaactatccagcacgtgttcttttgaaatagtcgtcataataaatgtcctttaaatatttagcgaattgccatttggaataaaaccacttcagcttgacaaccaaaaacaatacgcatttttaaacgaaaaccatttgaaatgtcggtaatttgactctcaatatttgcagggtcattttcaatatcacgagctttctgaataaaataatcacgagcgttcaacgcttgtttttccgtatcgtattccgcttcaaaaacaacttctcttgcggaattatccagcattgaatcgcctttgatacggcacatattgtgtgcttctgccactttttgttgcaatgttttatcactcatgattatttccttatgcttaataaattaacctaccacactcggtaataaacctgcttgaactaggaatggaataatcacaataaatacaccaataactaatacagcgataagggaggctgagccaccttttactcgatacggtaagtgtgggtaaattttacgtaatttccataccattgcaataggtaaaacgattgcatagaatgcaaacatttgtcctgcatatcctaaagctaggataaacccttgaggatagaatagtgcaaaagcaagtggcggtaagaaagtgagcagaccaactgaaacacgattagctgaaatatttactcgttttagcagatcttcaatcgcttcgaacaaacctaaggcaacacctaagaatgaagtaattaatgcaaatgcagagaatagacgaactgcaccgccaataatttcacttcctgtaattgtaattgttgctgtcaccaatccatttaaggttggatcttgttgtaagattgccaaaaattctgtttggcttagtacgccatgagtggctaattgccatagaatataagcaacaagtggaataaaggttccgactaagatagaaacgcgtaatgcctttacatcgccatcaaggtatttattcaggctaggaatagaaccgtgaaagccgaaagaggtaaagaaaatagggcttgctgagatgattaaggcattatcaattggaagtgcgagtaagttttctaaagagactttaggcagtaataagaaaagcactacaacaaagaaagcaattttactgaaaaaaatgatgcgattaatcttatctacgctatttgtgcctgaaataatgaaaataccgaaaagtacagtaaataatacacctgcaatccgagatgtggtttgttcatcgtgaatggtgggcaacagtcctgcaagtaaagagcttccgccggaaatgtaagctgaaactaaagcgtaaagaaaaattaacagtacaacagtagaaagaatacgtccgaaagatccgtaatatttttcagccaaagtcccaattccagcatcactgtctacagtctgatatagctcaacgaaaagtagggcggcaaaagagagtaatagccaaagcccgattaataaagtaagtgtaaagccaaaaccgattccggctgaggttaatggcatagcgagcatgccaccgccaattgttgttcccgctacaataagcgtacttccaagcgttttgttcatatttttctcccatgatgaaaataaaagtgcggttattgtaacttatatttttttaaaagtgtaattttatttttacaaaatgtaatattatatttacacatttgttttaggaaagagaattggcttaggatcttgatagaacaattgtactttttgtccaatttctaaggattgcattgtttgaatggtgatttgttgtacatcagatagagtaacttggtactgataatattgccctaaaaattgactttgagttattgtaccatgcccctgtaaagttggtatgacctgaatttgatgtgggcgaaccagccaatgtaactccgtattttgtaatagtggagattgatcagcaagtgtgagtaagttgtcgataggctgtataccaaagattgaatgtaattgattttgttgatcaatatagcaatcaatatagttatatttccctaaaaattcagccacaaatttactgttaggttggtaatagagttgatctgttgctccgacttgaataatttttccatctttcatcaatgcaatattatcggcaaaagcaaatgcttcttctttgctgtgagttacaaagattgctgaaatgctttgttgtttcactatttgtttaatttcatcaatcatttgatagcgaacttggctatcaatatttgaaaaaggctcatcaagcaatagtagttttggcttgcatgctaaggctcgagcaatagcgacacgctgttgttgacctcctgacagttggtgagggtaacgatcttccagtccatctagatgaactaagttaagcatattttgcgaaatttgctttttttccatcgcactttttttatccaaaccaaactgaatattttctttgactgttaaatgaggaaaaagagcataatcctgaaaaataaaacctatgttgcgttgttctacagggacaggtgttaaatcttgtccatttaagtagatttttccttgtgtaataggctgtaatccggcgatggcttttaatagtgtcgtttttccgcaaccacttgctcccaataagcataaaatttcattttttttcaattctagatcgagttgatgtaagacaatttgttgtttgtattgacaactaagtgattgaattttaagactattcattatcgatccttttctgaatgtaaaatgagtgaacgagtgagccaaataacagggattaaaccaacgagaattaatgttaatgcaggcaaagcggcatgttctaattgttcatcggaagtaaaagaaaaaacataagttgctagggtatcaaaattaaaaggtcgcaataacaatgaggcgttaagttctttcatactttcaataaacaccattaaaagtgcggttaaaattcctttagaaagtaatgggaagtgtactttttttaacatttttatgccattagtacctaagctttgacttgccatatctaatgtaggaggaattttttgtaatgatgtttcaatacttccgagagccatagcggaaaagcgaatgacataagcggaaactaaagcaaacattgatcctgaaaaaattaatcctacaggagataaatttaactgagccagtatagcgttaatttgatgatccgcaaatgtgtaaggaattaaaataccgatagctaaaactgtaccgggaatagcgtagcttaaactcgcaaagcgtaaggtgaattgtgcactacgttgtatgtgatttgaatgtagatttaagcgttggtaaaaatgtaaaagcagagcgaaaattacacaaacaattgaggcggtaatagaaactgacaaactgttataagcatattgtgaaaatttatagagttgtgattgttcaaaataatgaattgcccaataactcaattgtgcaacaggaataaagaaagcacaagtgactaatccccagcaataagtttgtactaaaaagccttttattccttttaatggcttaagtgcggtctttttttcataccctcgttgataggttttttgtttgtaacggctataattttccagcaataagagactaaaaataagcaataaaatgaacattgagatttgagcagccgagccgagatctcccagtcctaaccaagtgtcataaactgcggttgttaatgttggcactgcaaaataagatacagtgccgaaatcgcccaaggtttccatcgcaactaaagcacaaccaatagcaattgcagggcgagttaaagggaaaataattttttgtaataacttgcgtggtgagcttccaagtaatttagcactttgaattaaattttcgctttgttccaataaggctaaacgtactaataggaaaatataagggaaaagaactaaagcaagaacaatgcaagctccccataatgttctaatggaaataaaccaataatcttgtgcacttgaccatgaaaaagtttgccgtaaaaatacttgtacagcaccggcatagtctaataaatccgtataaagataagcaactaaatagccgggcatagcgagaggtaaacacaatagccattgtaagattttttgtccggtaaattgatattgagaaataaaccaagcacaaggcaaagcgaaaactaaactaaaagaaacagttccaataacgagaagcaaagagtttagcagataatcaaacagaacagtttgccaaagatgttgaatgttttgccaattgaggctccaagattgataaaaaatagcaatgatcggtgttacaaaaaacaacgtaataaaaagtgcggttaaaaaccaaataattttatttaatcttgaggaaaataaaaacattcgaaaactaattataaagtaatgtaaagtttaatggggcaattatagcataaactcaaagtcagtgagatcattaaatgcccagtttagaaacaggataaacaaagaaaaaagcctagtggatttagcatactaggcttgttcttttagcaaatattaaagatcgaatttgacttcatcaataagttttaatgctttatcgtagttttccgctattttatttagtggtagcggatctttcttaaatgttccccaagatttcactttttcagacggttcaacaccagcttttacaggatattcatggttaagctctgcgtataaatgctgtgctttatcaccacttaaatattcagcaagtttaattgcgttttctttatttggtgcatattttgcaatagcaataccgctaatattaacgtgagtaccttttgctttttggttagggaagttgatataaaccgcttctgcccaagagcgttgtttttcatcgtctagcatttttccgaagtagtagctattgcctaaagaatagtcacatacaccttctttaatagcttttacttgatcacgatcgccaccttgtggtttttgtgccaagttgttttttagtccttctaaaaatgcttttgcttttgcttcaccatcatgtgcaatcatagaagcaacaagagaaacattgtaagtgtgtttaccagaacgcacacaaacttttccttttaattcaggttttgctaagtcataataagtgaaatcagcaggtaatttacctacacgatctttagaagtgtaaatcgcacgagcacgagttgttagtccaaaccattgatcattagcatctctatattgtgctggaatatttttttctaagatttcgctatggataggttgtgcaagacccgcattcacaatttccatcacacgtttaatatcaacagttaataatacgtctgctggacttaattcaccttcacgttttacacgttcaactaagcctttattatcaaaaagaacattaactttaatccctgtttctttttcaaactcttttaaaattggttcaataagataaggttgacgataggaataaacattaacttcatttgcagctaaagcactggcggaaacggtcgctgctaaggctaaggttaatgtgctgagtgattttttcatgaaaactccttgtaagaataaatattaagtaaaggatacgaaagagctgtattaaatactttaatagattaaaagtcaataagaattattcttgattgtgtaagtaaaattttaagttttatgaccgcactttacacaaaagggaaaataacttgattattttcccttttaattcaatttggtaaagcggttattgccaatattttttctttgaggtttgacctattcccggattgaaactatttgttgggtcaagggctttgtagaatttgcgtaattccggttttgcttgatacaaatgcccaacattatgttccgctggatattccgcaccacgctgatctaataaatcaagcatttggtgttccaattctgtacaattatggccttttttaatgatatagtcttggtgaaaaacatggcacataaaatgaccgtaataaagtttgtgtataattttattttcaatttcagcaggtaatttttcaaaccattctttgtcattacgacgcaaggcaacatccaaagcaacgatatcttcaacatctttatcgtgaattgcacgataacgaattgcagctgaagcaacagcaaaacggtgtaacattgctgcttgagtttcttctgtattacattggaaataattacctttagagttatcggaaaaatactcttttaagtattcttgagcttcttgaacacctgtaccacctatttttacaataagatgatgttcatattggtcacggtattgccataaagatttcggtaaatgttccggcatcgcttttgataaaatttgcataaacttatcactgaaatcattggataaaaaactgacttttttggcgattcggtcaactttagctttcaaggcaaataatttaggtaagcggtgtgtgccaaattttttaataatccaaaaagtatctttaccgtatttggcggcaatgtcaaaagcatcacgatgaatatattcgccagagattggcaattgttggaaattagctaacatatgacgacgaatgtcgtttaacacatctgtttgatttgttccaatgtagaaaactgcggtatgtttttccatcggaaacgtatctaagcggactgcaaaaacagctaattttccggcactcccggaggtttcataatgtcggcttggatcagcgttaaatcttgctggagagttttcatcaatttggcgtacatgttcgcaataagaatgatcgtgtcctctgccacaatgttgttgaatatctttgcgttgataacgttggttttgtaaattttccaaaatttcttcaggatcattacctaagtcaatgcctaaatgatttttgagttccaattctccctgttcattaagttgagcataaagtgccatttctgtgtaagccggtcctctttgcaccaatgcaccgcctgaattattacatataccgccaataacagaggcaccaatacaggatgaaccgataacggaatgaggctcacgcccatgtgtttttaataaaatttccaattcatttaatgtcgaaccaggtaagcaaacggcttgctcggcattattgattagctgaataccgttcatatacattgtattgataatcacaatatcacgatcatagtcattaccgcttggtgttgatcctccggttaaaccggtatttgcggcttgatttataataattacatcagcctcaacacaggcttttaatacgttccaatattcaaccagattagtaggacgaacaacagcaatcgcatttccgttgccaaaacgatagccgctacgataactttctgttttacttggatccgtaataataaatttattgcctacaatgtcggtgagcttggagataagttgttgagttgtcatcgtcataaaatgttccttgcttatttgaaaaaatcgacaacattataacaaatgaatgttgactataaatgatgaaactctattcaattatacagtttttttgatgattaaaaagataattgagtttgagctaataataaaagatgagttttgttgagaaatatgatacaaaagacaccgaatttttatttactcttaattaggaaacgatatgtcgaatttacaaaatattattgagcgtgcatttgaacgtgtagcagaaattaccccgacaaatgctgaagcagagcttagagcagcggtagatgaagcgattgaaggattagataaaggtatttatcgtgttgcggagaaaaatgaacaaggcgaatggattgttaatcaatggttgaaaaaagcggttcttctttcttttcgtttaaatgacaatgttgtagttgatggtgcagaaacaaaatattatgacaaagtgccggtgaaatttgcagattatgatgtagaacgttttaaaactgaaggatttagagccgtaccgggagcggttgttcgtaaaggttctcatatttctaaaggtgttgttttaatgccgtcttttgtcaatattggtgcttatgtcggtgaagggacaatggtcgatacttgggcaacagtgggttcttgtgcacaaatcggtaaaaatgtgcatttatccggaggcgtagggattggcggagtattggagccattacaagcaaatccaacgattatcggcgataattgctttattggtgcacgttctgaaattgtggaaggtgtgattgttgaagaggggtgcgtaatttccatgggggtattcattggtcaatcaaccaaaatttacgatcgtgaaaccggcgagattttctatggtcgtgttccggcgggttcagtcgttgtatcaggtagcttaccttccaagtgcggtaaatataatctttattgtgcagtaattgtaaaaaaagttgatgcgaaaacattaggcaaagtaggcattaacgaattattaagaactatcgaatagctaaaattcatgtagtttctattatctacctgcctcttaacataagaggcagattttttataaaacaatagttttattttgatacacaaaaattctgtcatgaagtgccaaatctaaagcctgcgttagtaccgctttttctacatcacgtcctgccttcatcatggcttccgcattataagtatgatcaacattaatgacattttgcataataattggtccctgatctagctcattattaataaaatgtgctgtcgcaccaataattttaacccccctttcataagcttgatgataaggttttgcaccgataaatgcgggtaaaaatgaatggtgaatattaatcactctattgggataacggctgacgaattcgggatttaaaacacgcatatatttagccaaaacaatataatctggagcatattcgtcaattttttcagctagtaatttatcatgttctactcgagttaatccttcatggcttacacaatgaaacggaatatcaaaacgctcgaccaacgaacacaaagtttcatgattcccaatcacagcggcaatttctacatctaatccgccataataggttttcattaaaatgtcgcctacgcaatgagcctctttggtaactaaaattacaatacgttttctttttgcatcaactaaacggcaatttgtaccattcggtaaactatagtctaaatcggcaagtaaagtttgttgattaaaaataccttccaattcagtacgcataaaaaagtgtttagtttcaaaatcaacaaattcattattatgaataatattgagctggtgtttgtaacaaatattagtaattttagcgattaaacctttatcatcaggacaatctgttaataggattttattttcaaccataataaatagtgatttattgtgttaagttaataaaaacttaagttagagatttatagcatgattaaatttcgaaatcagccaatgtttttcctgtatttaattcagcttgcagagataaaggcatacgcccctgacccgtccaagtttttactttaccattttgatctgtatattggtattttgctttgcgaggagctatttttttacgagggcgtttagtggtaaaggttggatcatcgactaaatcagtcaaggttaagccgtcttgtgctagcaatgctttatattttgcgatacgttccaaacgttcttgttcttttcgttgattttcttcaattagttgacgtcgttcatttgtaattaattgaaatttctccaatatactttctaactcttgcagagtgaattcttttgttgctacacgcaatgctcgaatactggttaatgtttttaataggtcagacatttttactccttaattttatattgataattcgctttcaaataataacgaaaaaatatttttaggtaaatcttaatttaaaaatagtctaaattttaattttatatattagtttaattattttacattaattatagattaatacttggaattttgattttcttattgtaatcttactcgctcctacatatgtagaggtgcggctgttataagtaattttttgagtggataacgatgaaaaaaatgaaaggaatagttgccgaaatcaattaaaagtcattttaattggttgggggcgtattcgaaagaaacgtcactgtcatagtatttatccactatggagcgctactggttaggttggtatgggttattttgatcaccttattttaattatatttaaaatatcaatctcagtggttctcccttaaattaggaagaacaacatggaacttgtaaattattccacatctatttattcggttattccaccgatattagctttgctattagccattgtaactcggaaagtcattttatctttaagcattggtattattaccggtgctttaatgttgaccaaagatacatccatattggatagtattccttatttgtggaatcatatctccgctttggtttatagtattgaagaaaacagctcaatcgcatttgcgtgggacacaataaatattatcctctttttagttttacttggtgttttgactgcacttttaactgtatccggtagtaaccaagcctttgctgaatgggctcagaaacgtattaaaggtcgtcgtggtgcaaaattaatggcggctgctttagtgttcgttacgtttattgatgattatttccatagtttagcggttggtgcaattgcccgtccggttacggataaattcaatgtatctcgagcaaaattagcttatattcttgattcaacagcagcacctatgtgcgttatgatgcctgtatccagttggggggcttatatcattaccttgatttcgggactattagcaacttatgccattaccgattactctccaatcggtgcatttatggcgatgagttcaatgaatttttatgcaattttctctattttattggtatttttcgtggcttatttttcatttgatattgggtcaatggcgagacatgaaagattggcattagagagaggggatacagaaagagaagttgaaatacaaacaaagataaaagggcatgtacgaaatcttgttttgccaatagtggtattgattgtagcaactgtggcaatgatgatgtataccggcggacaagcattaattgctgacggtaaagcctttagcgtgctgggtgcatttgaaaacacaacggtagggatttctctcgttgttggagggattgcctcagtggtgatggttactctctgtattttaactgatggtcagattagtttaaatgaatatataaaatcttggggattgggtgcaaaatcgatgtccggtgctattttaattctgtgctttgcatggacgattaattcggttgtgaaagatatgcaaacagggacatatttatccagccttgtatctggcaatcttcctattgcaacgttaccggcattacttttcatcctcggtgcagtgatggcattttccacaggaaccagctggggaacatttggaataatgctaccaattgccgcagaaattgcatcaaatgctgcccctgaattaatgttaccttgcttatctgcggtaatggctggtgcagtttgtggagatcattgttcccctgtatctgatacaacaattttgtcctctaccggagcgaaatgtaaccacatggatcacgtaacaacacaattaccttatgcgttaacattagctatggcaacaattgtaggctacttagttgtcggtttcacgttatccggattgttaggttttatcgcttgtggcgtaacattagctgttttaatgttaattttaagaaaacgctaatatcgttttaattttgtttttgaaccgcactcataagtgcggtttttattagagcggagtttaaaataagtgtagaatagacaaaagttatcgtttatttcttatttaggagtaggagcaaaacatggcaatcttagttaccggcggtgccggctatatcggttcgcatacggttgttgaattattgaatcatcgttttgaaattgttgttttagataatttatcaaattcctcggaagtttctttacagcgagtacaacaaattaccggaaaaaatatcactttttatcaaggcgacattttagatcgagaaatactacagcgtattttttcaacacataaaattgaagcggtgatccattttgccggattaaaagccgtgggagaaagcgtaaaaaaaccgttgcactattatcagaataatgtgaacggttcgattacgttactggaagaaatgctaaaagcaggcatatataacttagtttttagttcatcagcaactgtttatggagaccctgaaatcattccaattaccgaaacttgtaaagttggcggaacgactaatccctatggaacatctaaatttatggtagaacgtattttacaagacgcagtgagtgcaaatccgcacttgagtgttgtcatacttcgctattttaatcctgtcggtgcacatgaaagtggtttaattggagaagatcctaatggtattccgaataatttattgccttatatcagtcaagtagcagtaggaaaattaccacagctttcagttttcggtagtgattatgatacacacgatggtacaggtgtgcgtgattatattcatgtggtcgatcttgcaattgggcatctaaaagcactggagaaacaccaaaatgatcaaggctgtcatatttataatctaggcacgggaattggatattccgttttggatatggtaaaagccttcgaaaaagcaaatgatattcaaattccttataagctagttgaacgccgtccaggggatatagcaacgtgttattccaatcctcaaaaagcattagaaaaattaggttggaaaactgagcgagatttaacacaaatgatgaaagacacgtggaattggcaaaaaaataatcctaatggttataaatcgtaagtcgtaagtgagcgttttaacatacggataagacaattcagctatcaacatttcaataacaacagaacaacgttgagtgtttctgttgttattttaaacgatttagcaaaaaagataggcgacaaatcgcaaagaataaacttttttctaaaaaacattttctttacatttaaagttaggataaaatcgcccggataaattaataatacttgacaaataaaaatagaatagaaaaatgtctacagtctacagtctacagtctacagtctacagtctacagtctacagtctacagtctacagtctacagtctagtatattgcctaaaatcaaccttgcaaggtaaatttgtgaggttggacatgttcaaacaacatcttaaaaatcacctatttcaacctcaacctttcggcgaaagtattattcgcctttttttgttgtgtcttaaaaagcaaggcatcgccgatttatttatcaatctatctaaaaagtaaagcgtttaattaatcaacaaccataaaaaagttaaaaaaaatcaacaaaataaacaattgaaaaaaacattttaaaagattaaagagagtgaatttatgaacaaaatcttcaaaaccaaatacgatgtaacaacgggtcaaacgaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaatgtccgctattgctataggaactagtgcaacagctaacgctcaaaatagtgtagcgttcggaaatgaagctcaagtaagcatggaaaattcggtagcattagggagtaaatcacatacaaaatatttctatcaaaatgataataacaaaaacacagccacgctcatcggaaacggcacaaatgatgcgattaatttagatccctatgttccagaaggttctagctataacttaaaaaccgataaagcggcgggtattgtgtccgtcggttggacaaaaaatggcaacggcaaaacacaagaactgggcttaagacggattgtcggggtagcaccgggtgcgttggaytctgacgtggcracsrttggacarttaaragccttrkmytaygtaaaaaaagagggcgtggtaacttactataccaaagagggaaacaagatcattaagctgaccaaaggtgatgatggtaagttctataaagtcaacaccaaagacggcacgccttacaaggacttaggtgcggttgacgcaaaaaatgttttcgttggtccaaaaggggcgaatgaagaaacaagagaagaaatgattcagcggaaaaaatactcgctcggaaatatgggcgaaagaatcaaatttgctaatattttagatggcaatattgaaacaggatcagatcaagcgattacgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacacctttttatttaggttcaaccattgtaatcaaagcaggggatgttacaaagtcaggtgcaacgatagagaaatatctaggcaaaaacctaaaaacagaatttaaaaacgatagttcaaaagcgacattcaccatcggcttgaaagaagacccgagctttaaaaaagtcacgattgaagacaagattgaggataaagaagctaatacgaaacttgccgtcaacaaagagtatgtggataacaaactymaaaaygtytcgacsaatttacatttcttatcagtacaagggawkgataaarmygcagwcaactataayaacgatggagcaaaagcaaattattctgttgctattggggtgaatgctcaagtagtagatcctactactagtggagtgcctcctaaaaaaacaaaaccgacagcaacagcaggtatagcgataggatataacgctaaatctgaagcagaaaatgcggttgctataggtagagatgtaagtattgacgtaccgaattcttttgttatggggtctaataatacagttacgcaaagctttaaagagacaaatggtgcggttgttgtgatcggtagtggaacaaaattagtagaatcaaaaagttctattgctataggtgcggtttatgtggaaagaggtgacaaaaaagatggtactgtaatagagaatgcagcttggacagcgtctatcgggaataaaaataaaattaaaaatggtacggatattgttgcactggggaataatattgaagtcaaagatgaaacaaatgaggaaaatccaaaaaataaaacaagaattgctaataatgatttaattctgattggtaatggagcgacagctgaaactgcaaaagaaagtgtgcttattggggcaaaatcaaaagctgaaacgggtgcaaaaagtgcggtgattatcggtcatagtgctaaagcagaggcaaacgccgtcggtgcagtagcgattggrcaaggtgcaacagtaaaaaccgmcgcyggcraytccattgcsttggggcaagggtcagaagcrackgmwaaagaagaagctaaaaaagacgctactgtagctattaacggtaaaaatattaaatttaaatggtcaggtggtgttagttctaatagtggagataaaaaatccgttttaagcataggtaaggtaagtaatgagcgtatcatyaaacacgtcgcygcaggtgcggtagataaaaattcaaccgacgctatcaacggaagccaactttacgctgtcgccgatgaattttctaaattagcggtgaatgtattgggtgcggaaaaagccgacggcgatacagcaggatttaaaaaatcgaattttgaagtagctaaatataagggaagtacaactgcttcaacaccaacagaaatgacctttaaagacgcaattggtcaaaatacaacagcgattaatcaaggctttatttttggcgttggcgatcaacctgatgaatatggaacgcattatctaggcgataaattaacaatcaaggcgggannnnnnnnnnnnnnnnnnnnnnnnnnnnnnnnnnnnnnnnnnnnnnnnnnnnataacattaaaactcattatgaaaaaggtaataaaaacatattaataggaataaaagataaaccttcttttaaaaatgtgattattacagaagaaattcctgaagatgaggaagtgcttaagaaaggtgcttatgataaacatgctgtaaataaggcatatttagacaaaagattagaaaaagtcgccgctaatttcacggttaagggggataattctaaggctggagaaggatatacmttagrtaaagatcataatgaattaayaattgcaggagatagtaaaaatattgaaactacagttgataaggacmataaaaaagtcagtatcrmmttaaaagakrctttaacaggtatyacttcaattgctaataatgatacaaaaattgagctaaaaaatggaactggtggaaatggaacaaaatctatcgttttcacakcwggmgataacartaaatctgtaacrytaacyggmgataaattcagtggtgtgtctgaaattggaaaagatgatcaggctaaaatcactttcaaaaataatggttcaaatgaaatagactttaaagcagggagtacaacctataaattcactgacagcgaattagatttagccaataaaccaataacaaatctagcaagtggattagataatgttgtaaataatggtaaaaaagacttagacgaattattaaaacttatcgggacaaatgggcaaccaagcggatcttcaaatgatggcaaattaaasaaagcmrtcaatgywrrmgatttrcttcatgtygctaatgaattraaaaataaagggctgwcwttccaaggaaatrgtgatgatactgacaaagttacyagaaaaytgggsgaaaccttaaaaatagttggagaaacatcgtcaacaggtagcacacaaacaacagaaactgcagctggtaacattaccgtcgctaagaaaaatggcacgactaatgaagctgayaccttagagattaaattgtctaaaaatttaaaaggtatygratcagttgctaatggagangatrtaaaaattgaattaaaaactactggaactagtggaagtaatacaaaatctatcgttttcacagctggwgatarcagtaamtctgtaacrctaacyggmgataaattyagtggygtktctgaaattagcagtaaagataataaatctacattaaaacttggtgttgataaagcaactgtagaattagaatatggcaaatcaaaacttgaactaaaagatactgaagcaacaatcacagctggagataatgccggaagtattaaaattacaagtaatagtgataagaaaattgagttaagtcctgaaaacggagcgacattaacactagcaaaagatagcacgacgaatggaggtgctaactatgttaaagctaccggtttatctcatgttgggttaaatgaccaaaacgctttaatctttaaaaatggaagtagtaatagcaataccgctgttttaaaagtgggtaatgctgatttaacatttacaccaaccggaagtaatggaaatcaaaaagtccagatttcaggattatcaagcggattaactgatattggttcttctaccggtattagtggcaataatagtactcaaaaattagatgaattattaaaactaaaaccacaaccaagtggaacatcaaataatcaagamaaattaaryagagcmgtaaatgtagaagatttacttgatatygctcaaggcttggttgataaaggacttaaattccaaggaaatgacacttcaagcacaataacaacaaaactaggcggtactttaaaaatagttggagaaacagcaactttaacatcgggaacaactgcaacaactcaaattaccaccgcacctgataacattacggttaagaaaaaatcaggtagtgaagatactttagaaatagggttatctgatgctttaaaaggtattacttctattagtggtaaaaatgacagcaatggaagtgcggttgcaaaaattgaatttamtaryrsygryacwggtrgyrgtacttcaaccagcccaacggtcaaaatcaccgcwggcggyggaacatttacctttggtgacaatggattagatttaggtaataaaaaaatcactaaacttgaaagcggtttaggattaacaaatggtactagtacaggtggaagtactgtaaacggaaatgctgacattattaaaaaaatcctcgaaggaaatcctgacggcacgactggttcccctaaaattgccaacaacgccgtsaatgtgaaagacctgtccgaagtcgctaaagcgattgtgactaaaggcttgacctttgcagggaatacaggtgasgytaaagcykcactcggcgataaaatcacgattaagggygakggaacgtatttaaccagcaaggcttcttcaaatggtagtaaagaaattgtgttttctttgacggatagcacgaaaaataaagtcgatattatcaatgtcggcactactaacaacggcgayaattcctttgcgttgggtaarrattcaaaactagagacgaaaaagaccgcacctagtggaattataccgaatgcaggaaaagatgaagtcaaatttagctggacaacagcaggggcttctaaaactacaratcctrctgatatgaaagaagtcattagtgttggtratacaaacgctgaacgcattattacgcatgttgccgctggtrawgtygmyryyggttcmacygatgcsrtyaacggcggacaactwaaragygtaatygatgtctttgctaatttagggataaatgtattgggwgctgaaaaagccgawgctgacaaagacggctttaagaaaactacatttaccgcattgaaaaatacaagcggagcaaatgaagcaactaaagatacatttaaagacgcaatcaatgccaatactgccaaaatcaacgagggcttgaaatttaaaggcgataaaagcgatggtagcaatagygagcaacaactctacctcggytcaaccttgacgattaagggagcggaaaycaccgcacaaacacctgctcaaggtgcgggtrcagccaaacatcaaaacattaccactacsscmaaaaacggtggmataytggaaatcgccctgaacaaggatttaaaagrcattacmtctatcgggaaagatgataataatgttttaacstttgmaaatrgyacaagtggtggaaattcagcggtattaaaagtcggtggagcttctttaacattcaccaaatcagataatggtgacaaggttaaaatttcgggtattgcagatggaaaaagtgagaacgatgcggtaactgtcaaacaattaaccgcctcaaaattgcattatttatcggtaaaaggaccaaatggaactcaaaacggtgagaattacaacaacgacggtgcaaaagcccaaaattctatcgccataggttctaaggcaagcgtaaaagatgaaggttcacacgatgccatcgctattggttataactcattggtagaaaatgccaaatggtcaatggcaatcggtgcaaatactcaagctaaatcaattcaatctttggcgttggggtatgagacaaaagtattagaaaatagcgatgcttcaatagccatcggtgtatctgacacaaaaatagaaaatgctaaatgggcagtagcattaggaaacaaaataacaataaatggttccggtaataatgttgttgcaataggaagtaatmttaatgtaggaagtggcaacgatgatttaatcgtaataggaaatagaggcgacagttcaccacaaatamnaaacgccaaaaactccgtcattatcggyaaacaggcaatttcymaagcggaaagtgcggttgttattggtacgagtgcgaatgttgaagcaaacgcaacaggtgctgtggcgattggggatagtgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggaaatcgctttgaataaggatttaaaaggtattcaatccatcgctaatggtgagaaagcaaaaatcgctttggataaggacgagaaaactattannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtgcgaccttaagtgcgggtaaagataaaggaagcattaaagttagcaatggaacatctaacaaaatcgagttaagccckgaaaacggytcaayygttacgtttgcaaaggacacarcraatggtaatactgtcaaagccacyggcttrtctaccatcggtaaagatgrgrataacgctttagtgtttaaaaayggtacgagtggcacaagtggcacaaacacggcagagttaaaagtkggyggwrckacgttrammttyacgccaacgaatggarcyggaaatgctaaraccgtgaaaatctcaaatgtggcggttggtaakatarmrastrrttcawcagaagctattacmggcggacaacttsmygatttagcwrstmawttaggggttgakgttgatagctcaggtaaaactgcgtttacancaccatcatttaatccgataaaaggtggtacaactcaaaaaacctttaagggggcgattgaccaattaatcaccgccgtgaatggtggcttgacctttaaaggcaatgatacttcccmaacttcaaccacattacaattgggcggtacgttaaccattgatagctcgacagtgggcaatggtacgaccggtgcgactgaaaaagacatcactgtatccttaacaccaaatggtaaagatgctaaagaggccggcacactcacgcttaaattaaataaagcaacagaagttaaagaagacgatgaaaaagtcgtgacttctaaagcggtagcaacagagttgaaaaaatatacgacaacagctgatttagataaaggctatctcaaagtcgatgggtcgaatattggtgaagatgaagagaagaagaaacaaggcagaaaaacattcggtagcaatgtcggtattgctgaaatcaagttagatagtgacaagagcgacactgaattagtacaggctgatgcggtgatagaatacctaaaaggtaaaggtgaaaaatccgttaaaatttccgataatccggaaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacaaagaagaattgtttatgtcgccaatccaaaaaatcaacacgatgcggtgaataaacaatatgttgatggacttggattaaatttcaaaggtaatgataatcaagagatacacaaaaaattatcacaaactttagaaatagttggtaagggtttaaataaagctcaaactgctaaatttaaaggaacaaatggaaatattgccgttaaatcaagtagtggtaaagataaaaaattagaaatatctcttaatgagaaattatcaaatattaaaacaatagaaaataaaggtagttcaatagaatttaatgcaaatgataaaaatggatctagcaaaacaattaaaaatttacttcttacaggaaatggaacaaaaatggttctttcttacaaaggagtacatttaaatgaaaaacaattgattggactaaaaagtggactattagaaaaacacaacggaaaagatcaagaaagaaaaggtttagacgatttaataggagaaaattttgataaatcatcgattaaaactcatgccgtcaatgttggagatttagcgaaaatttctaaggaaatagttgaaaaaggatataagtataaagctgatattccgtcaaataatagcaatgataccagcataaaactaggctcaaccatatctattgttaaatggacaaactcgccggcatcggggactggacaaccagcnnnnnnnnnnnnaggagataatttaacaactcgatatacctatgacagtggcaacgctaagatcgaaatcggatttaaagacgcaccgacatttagcaaagtaatgcttgctgaagaacaaacatataatgacgtaaatggaaatggcggaagaggaactagcggaaatacagattggaaaaaagaactcatcaccaagtcctaccttgaacaagcgttagatagctttaaattcaatgtggcgaatggtgatggtaaacttattgaaattggtcgtaatgatacgttgaagtttaatgctggcttgaatattcaattaacgttagaagagggtgaaaaaccggaaaatggggcaacgtctgcaagtagcacaagtgcggtaacttctaccccagcaccagcagtggcaagcagtccgtcaggtggtacaagtacaaacggcggtggtgcaaatagaggaggtagctcaaatggtgcaggttcaaatggtggcggttcaaacgggatggcttcgccaagtacaaccgcttcaactggtgctggcatggctacgacaggtgctacctcaagcacaatgccaacaagtacaccaacaaccactactacaccaccaacaacaacagctgtagtaaccattggtacaaaaaatgatttaactgatatcacctcgatttcttccaaacctaaggatggaagtgcggryggaagyrgtgcwggtkcaactggagaagtgacgaaacttacgttagatccgactaagggggcgactttccaagtgggcaagcaaggttctcaagtcactattgataatatgggcatgaaattcacaccgaaaggggcgaatggtgcaggtggggcgaatgatccatctgctagcacaccatcaattgtgattaatgctggttcagcaccagctgattcaactagttcagcacatccagctgatccaagcttgcctgctgttgataacggaccatctattactttctctacaaaagacgagagtggtaagaaaatcggtttcggtacgatcaaaggtcttgcggacattaagccaaatgaaacggatggaagcattgcagcgaataaaaactatgttgatagcaaaataaaagaagtgacagctggtcaaccttttgaatatgctacgataaaggataacgctaaagttgtgagagggttggacggtaaactgtataaagaggctgatctgaataagtattattacgatgagaaaactgcttcatataaaccaagagatccgaaaaattctagcatgactgaattaaaagcattaaaaaatgatgaagttatcgtaaacttaatgccaaaaggagatgataaatctccgatagcaattggaaatgtaaaaagtattttaggtgcagaggcttcaacagaccaagatgaagcagcaaaagcaattgaagaacttattaaagaaaacggaacgttatcaactaagaaagataatgttgcgacaggttctgatatagccgctttggcgaaagcaggtttgaatttcagtgtcagtacaggaaaagatattcatagaaatttaggcgaaaaaatatctattgtaggtagagatctgaaagcagaaattctaaaagaaatgaatatttcgaatggaaaagttgatgatgataaaaaagcagaatatgaagctaaattggcggtagctaagaaagcaattgctgatggatttagcactaagaatgtggttactattgccaatcaaaattctgttgtgatcaatattgcagataaacctgagtttaaagctatttctattaaagatgaaacagcacctggtatgtctttagatttaaatccaaatgcgattagtatggaagacgatgatggtaataacacagtcatggatgctggcggtatggtcgttactgataataacggaagtgctgaaattagcacgagcgagataagtttgacgggttctgatggtaaagaaagccatttggaagcaggtaaattggtattatctcatacagacaaagagcttgttattgaggcgggtgaaaaaggtggcaagataacaggcttggcagttcgtcatccaacagatagcgattatggtaccgatacaactcgtgcagcaacggaaagtgcggtgaagaaaaaccgagatgatgttgaggacggtgtaattggtccgatggtttatactgataacaaaggtaatcgcttagttaaagtagaaggtaaatattacctcgtttcagatgttgaaaatggtaaagccaaggaaaaagccaatgcggtggcaaatccagctctgtcgttagtgaatgctgatagaaatggaggagatacaaaagcccctgttgtgttaaataatgttgcagcgggagaactttctgaaaatagtcgtcaagcggtaaatggggctcagttacatcaaactaatgtgcatgttcaaaacaatagcttgcgtattaataacttgcaaaaccaagtcaatatcttaaacaaagatatgcgagcaggggttgctcaagctgttgcacaagcgaacttgccggtcaatatattaccgggtaaaagtacgttaagtttggcgaccggtaactatatgggtacgcaagcctttgcggtaggttattccagagtgtccgataacggcaaacttagcgtcaaattcagcttaggacatggcgataagaaaacctctgtgggtgcaggtatcggttatagctggtaattcttgacttttcatccatcaaaaaagggcgtttatacgcccttttttctattagtgtcgatattttttgtcaatctaaccgcacttttcgtaaatactaaattaatttaagcaatacctttatgtcgtagtagtgcatctaattgaggctcacgacctctaaagcgtttaaatagaatcataggttcttccgatcctccacgagttaaaatttcatctaaaaatgaacgacctgtttccgcattaaaaattccttcttcttcaaaacgggaataagcatcggcagataaaacttcagcccaaagatagctgtagtatccggcagaatatccgcctgcaaaaatatgactaaagctgtgaggtgttcttgcccaatccacacctttgatcaccgcaacgtcagatttaacctgttttaaggtcgctaagatttgatttggtttattagcttcaaaataatggtgtaaacggaagtcgaataaaccgaattctaattgacgtaaaacaaacattgccgcttgaaagtttttcgcttttagtaattgatctaatttttcttttggtagtggcttgccggtttcataatgtcctgagatgaatgctaacgcctcttcttcccaacaccaattttctaaaaattgacttggcaattctactgcatcccaaggtacaccattaattccggcaacatcagcgacatcaatttttgtgagcatatgatgaataccatgtccaaattcatggaatagggtagtgacttcgtcatgggtgaataaagcaggtttgtcgccaatcggagcattaaaattacaagtcaggtatgcaacaggtttttgaattgaaccgtcagctttacgttttcgtccaatacaatcatccatccaagcaccgccacgtttattttctcgagcataaagatctaagtagaaacttcctctcacttcattcttttcatcaattaaatcaaagaagcgtacatctttgtgccaagtgtctacgtcaaaacgctctactgctcgaatattgaaaattcgtttaattaattcaaatagacctgaaataacttgatcttctggaaaataagggcgaagttcctcatcattaattgagtataaatactgtttttgtttttcgctataaaagctaatatcccaaggttcaagtgcggtgatattgtaatttttttggcaaaattcttgtaattcggtcaattctttctcgccttgattttttgaacgttttgctaaactttccaagaaatcaataacttgttgtggagtgtccgccattttggtcgcaagggaaagctctgtataagtattaaagcctaacaaatgagcaagttcgacacgcaaagtcaaaatttcttgcataacatctgtattatcccattttcctgcatttggtcccagttctgaagcacgagtagcaaaagctcgatacatttcttctcgtagttctcggttttcacaataggtcatgacgggtaaataactagggaattccaaggtaaaacgataaccatcaagccctttagattgtgcggattgttttgctgcttgtaatgcactttcaggcaagccaattagatcttgttcattttcgacgactttatcccatcccattgttgcatcaaggacattattactaaatttagcgtttagttcagataaacgagcaacgatttcaccgtatctttgctgtttatcttctgataaggcaatacccgataattcaaaatcacgcaacgcattttctatcgcttttttttgtgcaaccgtatattgggtaaattccggactattttttagttgcacataggcattatataaccctttatgttgccctaaccaagtactatattctgaaatcagcggtaaacaagcttgataagcggcacgcaattcaggactgtttttcaccgcatttaaatgagaaacaggcgaccaagcacgaccaagtttttcctctttatcgtttaggggttgaataaaattctcccacgtaaagtgcggttgttttaacagttgttctactgtttcacgattttctcggattaattgctcaatcgccggttgaacatgttcaggcttgatttttgaaaattgtggaagttctgaatgggttaacagtggattagacataagtgttcctcaaaatagacagttattttatataaaaaagtggtaagtagattgggatttattctagaaaatcaaggttgaggtctaaaaaatgtgaataatttaggggtattttattaatagttcataggaaaatttttattttgttttcattttatttttcatatcttattttgtgtactagatcacaaaaaagaaaaaaagtaaattaaatattaaaattaataatttaaaagattaatttcaatagataaacttacttaaagttagaaaacaggggaattccatgaaagagttatctgtggattgtattattgagcggagagattgtcatagtgctaaatgggaattagcaaaaaaatatagtgaagatattattcctatgtcggtagctgatatggatattccttcacctagagagttaatagagtatttaggaaagttaaataaaaaagggatatatggatatactatttttcctaataattataaaaaaataattcaaaaatattttttaagacattatggaagttatatagatgaagaaagtatagtattttgtccaagaataatacaggctgtttctatttatatcagagagtttacatgtataaatgataatatatctattttatcaccttcttataaaccattggtaaatgcaatttctttaaataaaagaaatgcaattttatgtgatttaatatataaaaataatcaatactatattaattttgatttgttagaagattgctttaagaaatcaaaagtatttatatttatttctccacataatcctacaggaacagtatggagtaaaaatgatttggaaaaaatagccatgttagcagaaaaatatggcgtttttattatatctgatgatatacatgcagattttaatttttccaacaataagcatatttttatttcatctgttagtgaatatgttgagaataattctattatatgtacatccccgtctaaaacttttaatattcctggattagaaatatcaaacttattaataaaaaatacctgcattagaaataaatttaaacatcacttagaagcattgggatttcataatccaaattatttttctgcatctgcattaataattacatatagtaattgtgatgagtggagaaaagaattattggaatatattagagaaaatagatctttggtgaaagatttttttgaaaaagagattcctgagttagaggttgttaatagtcaagggacatatcttgtttggattaactataaaaaattaaatctaaatgaagataaattaaaatattggctcattaacttatctaaaattgaaatgtcttgggggtctgatttcttaagaggtggtgaatatttttttagaatgaatatagctatgccaagaatagttttaatatcttgtttaagaaaaataaaagaaggattaattttgctattagaggaatcaaattatggaaaataatatgaaaagaaaaccgaaattattagaggcattatctccaattttatttatgctatttttattggggtgcggttatgcattttttgatttgccaccagagcctttaatgattctttcatgtgtatttgcaggtattttagtgaaaaagttagggtattcttataatgatattttagattcaatttcatttaaaatatctaaaactatgcctgcattattaattttaattactgttggcttattaattggaacttggatcattggcggtactataccaatgatgatttattatggattaaaggtcattgatcctaaatttatttatattacagcattatttctaacagcaatagtatcaatttgtacaggaacatcctgggggtcagcgggtacagttggtgttgcatttatgggtgttgcaattggtttggatgccaatttagctgccacagcgggtgccattgttgccggtgcttattttggagataaactttcaccattatctgatacaacaaatatagcttctgctgcaactaatgttgatttatatgaacatattgctcacttactttacacaacattaccatcttttctaatttctgctttagtttatattgtatatggatttaatattaatattgataatgtagcaacacctgataaagtattattgatgatttcagggttagaaagtatttataattttaatttatttttattgatacctgtaataattattttgtggggatctatcaccaaaaaaccaacaattccagttatgttattttcagcagttatagcatcatttaatgcaatttttattcaacatttctcattaaatgatgttattaatagtgcattaaatggatttaatatctcaatgttacctgattctttaaatattagttcagatcttgcccgtttactgaatcggggagggatgaattctatgatgggaaccttattaatttgtttttgtgcgttatcttttgcagggatactttcacttagtggtgcattagatgtaatcattaattacttattgagattagtgagatcaacggcttcattaatttttattactattctttgtggtcttactatgattggtgtgacttgcaatgggcaaatatcaatattaattccaggagaaatgcttaaagatgcttacattgacagaggtttacatcctaaaaatttaagtcgtactgttgaggattcagctacaattatagagcctatccttccttggactgctgcaggggcttatatggctggtactttaggtgttgccacattaacttatttaccttgggcaatcctttgttggagcggtattgtatttgcgatgatctacggtataagtgggattggtatcgctaaattaaaacaagagtaacgtaggaagaaaatacttaaggaattactcgtccttttaattaaaaccagtgaaaaagagcggttagttttagaaaattttatatgaagcaatttttcgtatttgtatggtgaagctaaagctcgatattattaaaggaagatacatggataacacacaaaaatattaccgcattgctttattgttcaacgccaataaggtgtatgatcgagaggtggtggctggcattggacagtatattcaagcatcgcaatgcacatggaatatttttgtggaggatgattttgtttaccataaagaaaccattgaacgactgtctattgatggtattattgcagactttgacgatcctgaaaccgtttccttgttgaaaaatattgatgttcccactattgcggtaggggggtcttatcagaattttgctgattatccgcactttccttatgtcgctactgataattacgctttagtcgaaaccgctttttcccatttaaaacataaaggaattagtcaatttgccttctatggtttgccgactcaaggcactcggcattgggcaaatgagcggaaaaatgcttttgtagatctaatggaaaaatatgcttatcaattttctgtatatttaggtgataaaactgattcaggcagttggcaagtggcacaatctgaattatgccaatggctacaaacattgccggcacataccggcattattgcagtcacggatgcaagggcaaggcatttattacaagcctgcgaatatttgaaaatagccgttcctgagaaactttgtgtgattggtattgataacgaagaattgatccaatatttatctcgcatttctctatcgtctgttgctcaaggtaccaaacaaattggttatcaagcagcgaaaatgttgcatagcctgttaagtggacataaagtgagattacaaccaattttaattcctcccttaaaagtagaagaaagggcttctacggattaccgttctttgcgtgatccttttgtgattcaagcaatgcattatattcgccaacgagcctgtcatggtattaaaacagagcaagtattggatcatttaaaaatttcccgttctaacttggaacaacgtttcaaattggaattaaacaaaaccgttcatcaaattatccatgaagaaaaacttaaccgagccgtgtatttacttcgctttaccgatatttctatgccagaaattgctgaaatctgcggttatccttctttgcaatatttttatgcagtaatgaagaaagcctatgggataaccccaaaggcttttcgtcgataaattactaaagcactaatgatttagttactgattgagtaaaatcagggttgaaaatctaaaaaaaatgagaataattgaaaactgtttttattttattagtaagctgtatgaaaatcgtttatttaagttttggttttatttttctcgcattaggtattcttggcattattatgccgggattaccgggttttccatttttactcttgactgttttttgttttagtcgaagttcggagcgtgtgcataattggtttttgcaaacaaaaatataccaaaagcatgttttacctttcaaagaaaagaagggaatgtacaaaaaaacaaaatacaatatcttgatttttgcgactgttatgatggcaatggctttttactttacacccagtgcggtcggaaaagcgatcattcttatcgccttggtcattaaatattggtatttcttatttaaaatcaaaaatttaaaaacttaactggtattgtccaagtgtttttgtataatgccctaaataatttaaataagtaacaaaaatgcctttttatttctttcgtatttatctttttttattactaaaaagtgcggtactttttggtgtatttctgttatctgcttgtaatgaaaaacaagaaaatattaagactgaagtttttcaacataaacagtctgagcaagttcagttgcaagaaatagaaaaaaagcaattaacacgaggtatttatgctgagttggtcgtagatcctttgttgctgaaagaagaaggacaggcagagattttgcgtgatattttcgaaggattaacaagctacaatacgcagggtaagattattcctgcggttgcagaatattggcaaacggaagacaacaaaaactggatttttgtgttgcgtaaagatgcaaaatggtctaacggcgtcaaggtcatcgcacaagattttgtggatagttggcatagactggctttatctgataatccattgaagatttatcttcgtctaatgaatgtcagtaatgcggaatcagttttaaataaaatgttacctgtggataaattgggggtttttgcatcaaatgaacgcttgttacatattcaacttgataaaccgacaccacaattaccggcaatgttgacccatgctgttttattacctaaatatcaatcgacagataatgaatttataacaaatggtgcttatcaaattgctgaacgacaagaaaaacaaattgctttagcaaaaaatccttattatcgagaatcggaaaacgtttattttgatcgagttatttatcgagaaatttcccaaaatcaatcgattaactctttagatttcgttctgaatgcaaaatcatcgcaggaaaacttaatttatttgccccaattatgtgtttatttttatgagtttaatttttctcacccccatttgaaaaaaagtgcggttcgtagagcattaatttcaatggcaaccattccacaaacttttttttcagcgaaaatgcaagcaattcattcttttttgcctcattctttgcgattaggacaagaagacatttgggagccgactattgtggaaaaattattcgcagaaagccaaattacagaaaaatcgccgttaaaattcacgttaacttacgataaaacggaaatacaagaaaacattgcaagaaaatttattcaacattggtcgcaatcagatttaattcatgtaagagcaaatccggtttcaagagaagaattattgcaacaacgggcaattggtgattttgatattatccgttcaggctggtgtgcagattataaggaaccgtcaagttttttgcttaattttcattctaagagtccggacaataaaacaggctaccaaaatcctcaagtagatcaattactggaaaaagcgttgcagtctttagaagaaaaagagcgtaatattttgtatatggaaataataaaaattttgcaacaagagcaagtggtattgcctatttttcagcctcttatccccgtttggcaaaacaacattttgggtattgaacagaacaatgacagtggtgtgatatatagcaaagatttgtatcgacagaacaaagcaagcgaataagaatatcttatttccgcataaataacctatttaacttttaaacatattaaggaattattgtggcattagtgagtttaaccaatggctatctttcttttggtgatcagccgttattagattgtgcagaattacatattgaggcgggtgaacgagtttgtttagtcggtcgtaatggagcaggaaaatcgacattaatgaaaatattggcacaagacgtcatgatggatgatggacacttgcaatttgaacgagatttgattgtgtctcggttacctcaagatccgccaaactatgcagaaggcaatgtatttgattatgtagcggaaggtattggacatttagctgatttattaaaagattatcatcgtatttctctacgattagaaaaagaatacagtgaaacattgcttaatcaattagcacatattcaagctgaactggaacataccggcggttggcaatttgaaacaaaaattaaagaaattctaactaaattagatttgaatccagatactttattaaatgagctgtcagggggtggctacgcaaagttgcccttgccaaagcgttagtttgtaatccacatgttttattacttgatgagccgactaaccatttagatgttgacgcaattgaatggctcgaagaatttttattgacctttagtggcagtattatttttatttctcatgaccgctcttttattcgaaaaatggcgacacgtattgtggatttagatcgaggtaaattagtttcttatccgggcaattatgatttgtatttaacagccaaagaggaaaatttacgggttgaagcactaaaaaatgaactctttgacaaaaaattagcacaagaagaagtttggattagacaaggaattaaagctcgccgaactagaaatgaaggtcgtgtaagagcgttaaaagcattgcgtgaagaacgtcggcaacggagagaggtactgggcaaagctaaactacaattagataattcaagtcgctcaggaaagatcgtgtttgaattagaaaatgtttgttatgaggtagcagggaaaaccttgttaaaagatttcacaacgaccattttgcgtggagataaaattgctttagtcggtgtaaacgggtgtggtaagacaacgtttatcaagttgttgttgggagaaattaaaccaacgtccggaataattcgttgcggtacaaaattagaaattgcttattttgatcagtatcgtgccgatctcgatccggaaaaatcggttatggataatgtcgctgatggcaaacaagatattgaagtgaatggtattaaacgccatgttttaggttatttgcaagatttcttatttccgcctaaacgtgctatgacacctgtaaaagcactttccggcggagagcgtaatcgcctgttgttagcaaaattattactcaaacccaataatttattaattcttgatgaaccgacaaatgatttagacgtggaaacattggaattgttggaagaattattggcggattatcaaggaacacttttaattgtcagtcatgatcgtcaatttattgataatacagcaactgaatgttatatgtttgagggaaatggcgttctgaataaatatgtgggcggtttttttgatgcaaaacaacagcaagctaattattttgcttgtaaagcagaggaacaagttaagcagaaaaaacatgaagaagagaaaagaggcgtaaattcagtcgttgagaaagcagaatacaaaactcgccaagttaaattatcctataaagagcggttggaattagagcaattaccgcagttattagaagaattggaggaaaaaatcaccgcacttcaaatggaaattagtgatgtgaacttctttcagcaaccgcatgaatatacttcaacaaaattacagaccttagcagatatggagcaagatttagagagggcttttttgcgttgggaagaattggaagaaaaaaagaatttagccaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttatgccaatgcggcagctttccaactcgccgaggtgtccagttccggtttaggacgagcttatgcgggtgaggcagcgattgctgataatgccgctgttgtggcaaccaacccagcgttaatgagtttgtttaaaacgaaacaattctcaatggggggggtatacgttcaatctagaattaatataaatggtgaggttaatgttaatgtagggaagggaattgtacaagttgcagatgaaaaagcagatcagaaaaaggttgtacccggtgcattagttcccaatttgtattttgtggcacctattaatgacaaatttgctatcggtgcgggtatgaatgtcaactttggattacaaagcaaatataaaaaggattatgatgccggtgtttttggcgggactactgagctgaattccattaatttaaatttaagcggttcatatcgtgtcagcaaaggattaagcgttggtgcggggttaaatgcggtttatgctaaagcaaaaattgagcgtcatgcgggggttctagataaggcaattgatactattgccgattctaagggaatggctgggrgtatcaatattccttcattaamatygttagtcccaattttctcccagttaaaagatagagtgaatacggatactctcttaacacaattacaagataataatgcatggggattcggttggaatatcggtgcggtttatgaatttaatcaaggtaaccgtatcggtattgcctaccattctaaagtagatattaattttaaagatgatgatgcgttgagttatcaatttgaagcaggaaaaattagtcctgttaaagagaaaggtgggttaacgctacatttgccggattatttcgaaatttccggtttccaccaattaacggaaaaattcgccatgcactacagctataaatatactaaatggagccgtttacaaagtttacatgccacttatgataacggtaaggtcgctttccataaagatgaaaaatttcatgacagttcacgtgtagctctaggggcgacttataatgtgaatgataaattaaccctgcgtgcaggtattgcttatgatgagtctgccgaccatccgagtgcttcaatccccgataccgaccgcacttggtatagcttgggtgcaacctataactttacgcctaatctttctgttgatgtaggttttgctcatttacgtggtaaaaaacagcaatttaaggaaaagcataagattggaagtacaggtattgagttcggcagtatagatgcaaactataaatcaacagcacgtgccaatttgtacggtttaaatcttagctaccgtttctaacggctatccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttacttgcaatagttattcttccaaaatctctgcaaaaatctgaatccctttgactcctagtgcggtggctaacccaacgaaatccgctccagcggttttcattcgttcaaaaccggctttgtcattaacaccgcccacaccaataatctgtacgtcttttaattttggttctttatccagcatttgacgcagagtatagacattgcctaatgataatgcgtgaattgctgttcctgccagtcctccaatacctgttcctgtttcagaatttaatatggatttcccctcttgcatcactaatgaagagccaagcgtattagtagaagtaataaaggaaatcggtagtgttttattttctgttagcgattttaatagtccattaattaattcatcatattggttttgataggtaaatggtggaattttaatgccaatcggtaaagcctcttcccctagacttaacttggctaaagtggtttgtaacgcatttaaataaggtaataactcttctgcggcataggcaggcgaaatttctccgggcatattggggcaagaaatattgatttccattgctaagggcatcttcacttctgtttgcagagccacgatttgctcatagcattctcccacttcttcaggtgaaccaaacacggaaataatgaaaggcttgttggaaatagtctttaattcatcggagatagtacgaacaaagcgaatggtagtcgctaaattattgggactaagtccaattgtatttaagctggtagtttgttgtagagtagcatttgctgtattgacgccggcggcttgttgtgaggctgaatcaaataatacatattggttttttgcccaatcgtgtggataaggttcaagcatagaagtgcgggttgtaaccgcacctgtatattcacaggcgtaaagttcacgtaagttttctaattcagaacaccaagggcaaggagcatttaatattgcagggtgaatgtaaagttttttcattttaagtttctccatgaataaataatggttaataaaaaaggacgctataaatagcgtcccggtaagttaagattaattcttttcagatgtaacaaattcaatagaatggtaactaaatcacaagatttgatgttttttaatgaaaatttatggatatatattaacatgttgctgatgcagaaaaaacattaccatagaaagagtgttgaacgtggttgagaaagtcaatcttttatttatacaagatttctaaaccacgttattaaactggggcggtaatataacttatttcagcaaaaatgagaagctaatttagctatattttatctaaaaattttagggtattagaattcagtcaaaattttatcctttgaaagagggtaatatgttaaacatcgatagaaaatggaaaagtgcggtaacaataccaaatagaataaccagtagaatagtgacgtttccgcctgcaaccataaatccttgtttaccattaggtaattgacgtgatttgtaagccaataatgcagggataatacaagcccaaattgttgccaccgcacctgcataaccgatagctttcaaaaaacctaatgggaaagcaactgataatattaatggaggaaggaaagttactgcccaagattttgttctccctattttgttgtcatcaaatttaaataagtcagccaagaagtcaaatacacctaaacctacaccaatgaaagaggatagaattgcagcaatggaaaaagcattaatagcttgtttaaccgatgcagattcaattacatttcccaaagctttgagtaacacatctaaattgccatcactggcaataattggtgcaaattgatttcgtggcagattaccaaaaatggaaatgacccatagtaaatagagtgtaagggcaattattgttccgcctaaaatagctaatttggctttatattcatttttatagtatgcacgcattgttgcaaccgagtggtgataaccgaaagatgttaatgcaacgggtaataaacccattgtgtatatgacatagttattatctgagccggtatttgtattaaataaaatggctaagtcaatatttttagttaagccaaatacactaagcacaaaggaggttgccataaaaataattaatataacggaaatgcgatcgacaatgcgagtagaatgccaaacaaagaaagagaatatcaaaacgaagataattgaccaaactcgagagtcaatgttgaacatttcacttgttaatccacttaggatgccacctgatgctgtagtataagcgtacagtaaaatacctccaacaaaataaacggataaattgttgatgatgttgacagtattacctaataggcttttggtgactgtattaaaagaagctcgtaaatcaaaatgtttataagcctcaagtaataaccaaccggataacgtcatgcaagtcatcgtaaatccaatggtgaggacagaccaaatagtccaagctcccgcaccagatgtaggtaagcctaacattccggcaccgacacagacactcgcaataatgcaagcgccaccgaaaatagaaggtgatttttgcataatatagctccttttgaaaactataaaaaaacaccgcactttttgttaaaagtgcggtgccaaaattaaatctcttttaatcgagcggtgaaatgacgcagtactttaggttcataagtaaaatctaaccctttgatattatttgcattctctttcacttgtttgaatgcttcaatgatgaagtccatatgtgtttgagtgtaggtcgcacgaggaatagttaaacgtaacaattcagccgggcaaggtaattgttgacctgttttcggatctcgtcctaataggagagaaccgatttctacggatcgaatacctgctactttatataattcacaagcaagagcctgagctgggaattgttctgctgggatatgtggtaataatttgcctgcatccacaaaggcggcatgtccaccgggttgttgacaaacaacaccgatcttttctaaaccttgtacaaggtattcaatttggctaatacgataagctaaccaatcttgacgcataccatcacgtaaacctacagctaggcgttccattgcaccaccttctagaccaccataggtagggaaaccttcttgtacaacacaaagtgtacgacactcgttgtaaacatcttccattgaattatctttgaagcagagtagtcctcccataggtaccattgcatctttttttgcagacatagccaaggcatctgcatatttatagctttcgtaagtaatttgttcaatagtccaatctttgtattctgcttcacgttgttgaataaagtaggcattttcagcgaagcgagccgaatccataatcacaggaatatcatatttacgtgcaatttggtacatggctttcatattggcaagagataccggttgtccaccggcagaattacaggtaatagtacatacaatgtaaggaacattatttgctccaacttctaaaataccttgttccagtttttctaaatcaaaattacctttgaaatcatgatctacatctgtgtcaaaagcttcttttatatagacattacgtacagttgcaccatttaattggctatgaccttgagtagtgtcaaaaaaatagttagagaaaacaaccattttatttctatccaaccctttttcttgctcacgttttttgatcaagacaggaatataaatttgttctgcaccacgaccttgatgggttggaattgtgtattcataaccaaagatttctttcactgcattggcaagaacatagtaactgcgacttccgctataagcttcatcacctcttagcatggcagcctgcatatcttgagtaacggcacctgtaccactatcagttaatagatcaataaaaatatcttcactgtctaataaaaatagattcatgcctgcttttaagatagattcatcacgataggcacgagttgtacgtttgacaggttcaataacacgaatacggaacggttctggtaaatgttcgaaattttccatgattaaatcctcaaataattgattaaaaaatgtatattacaaaaatattattaggattgaggagttatgggaaaatacagggatagctttggatctacaagtatccaaacttgatttggtgataaaacatttaccatagcttatccctttttagaaatgaaatgtaatttatctcagacgaggaagatagtaacttagcaattgcactttgtcatatagaatgttttaaatttgtgaactaagtcaaaaattttgataaaaaataagactctacttatagagtcttatttttatgaaagtgcggtctatttccgcaaatttttattgtgtcgcttgaattgcagttaatgcaatagtatacacaatatcatcaaccaatgctccacgagataggtcattgaccggcttacgcataccttgtaacatcggaccaatagatactaaatctgctgagcgttgtactgctttataggttgtatttccggtattgagatctgggaagacaaatactgtcgctttaccggcaaccggagaatttggtgctttagattttgctacatcttccattactgccgcatcatattgtaatgggccatctattaataaatccgagcgtttttcttgggcaatacgagttgcttcttttactttctcaacatcagcaccggaacctgacgtgcctgttgagtaagagatcatcgccacttttggatcaataccgaatgcttttgcggaatcagcagattgaattgcaatctctgccaattgttctgcggttggatccggattaactgcacagtcgccataaacaagtacttggtcaggtaataacataaagaaaattgaagaaacaattgagttaccaggtgctgttttaatgatttgcatcggtggacgaatagtattcgctgttgtatgtatcgcacctgaaacaagtccatcgacttcgttagcctcaagcatcatagtgcctaatacgacggtatcttctaattgctctcgtgcagacgtttcagtcatacctttggctttacgtaattctactaaacggtctacataattttcacgtacagagacaggatcaattattgtaataccttttcctaatacaacgccttgagcatcagcaacacgtttaacatcatcaggatttgctaataagatacattctgcaataccacgttctgcacaaagactagcagctttaactgtacgaggttcatctccctcaggtaatactattcgttttttggctgcacgagctaactcagttaattgaaaacggaatgcaggaggagataaacgacgaggacgagttgaggcggcaactaaattttcaataaatgaagatttaaattgttggcttgtgtattgtttaatgttttcgatgcgttctttatcatcaacaggtacttcaaggttgaagctttgtagagccaatgcactttgccatgtgttaccttcaattcgaaaaataggtaagccggtattttcaaatactggttggcatagttttttaatttgattgtcaattttgtaaccacctgtgagtaaaataccacctagctcgatcccgttagtcgcagcaagtgcggaggcagttaggacatcaggacgatcagcggaggtaactaacagactacctgttttgaaatgctcaaccatattttgtaatgaacgagcacagaaagtaatactacgaatacgacgagttttaatatcgccctcatgtagaatagaagcacctaaatgattgaccaaatcaatagcacgagttgcaataagctccgcattccacggaacgcaagctaatactttaatagggcttttttcaaatagcttgtaaacctcattaaggttattttgtttatgttggtaagcatcaaaaatttcacttaggtctggacgagtacgtccggattcatcaattggtgcattaaatttattaattatgacaccaagtaagtttggattattttttccgccaaattgagaggctgccgcttcaatgcgttcttttaactctgccggcgtttctgttgcaggtgctgcaactaatacgatttcagcatctaacgcctttgcaatttcgtagttgatactgtttgcatagccatgcttgcgagttggaactaagccttcaacaataatcaattcattatttttagctagttgttgatgattttcaacaatcttttccagtaacacatcggattgattttgaccgattagattttcagccacacttagcataaacggttcggctgtttcaagtgttgtactggtacgcacaattgaagtagtgcggtctaatttatcttcatcggtacttggttgcgaaattggcttcatgaaaccgatttttgcccctttttgctcaagagcgtggattaaacctaaacttacactggttaaaccaacaccggtgctaataggaataaggataattgtacgagacataaaaaaaccttaaataatgttgttaaaaaagaaactgccgaatttatcggcagcctgtagattacaattagaaacttaaacgagcagtatcttgtgcaattacaagttcttcgtttgttggaataacgattgcgattggcgtattatccgctgtaataacaccttcattaccaaaacgagctgctgagtttttctcatcgtcaattttataaccaaatagttttaaatgatttaaagtaatttgacgaaccaaggcggcgttttcaccaataccgccggtaaagacaatcgcatctaagttttcgccaataatagccatgtatgaaccgatatattttgctaaacgatagcagaatacatctaatgcacgttttgcagcactttctttttcatagttatcttcagaataacggcaatcactcgtgacttctgttaaacctaacaaacctgattttttaactaaagtttcctcgatctgtgctactgacatgcctaacgtattgtgcatgtaaaaaatgattgctggatcaagatcaccggaacgagtacccatcaccaagccttccagtggagtaaagcccatggaagtatcaatacatttaccttggcgaattgcagcaacagaggcaccgttgcctagatgacaggtaattacgtttattttatcttcagcaatatttaaacgtttggcagcttcacgactcacgaaatagtggctggttccatgcataccataacgacgaacgccatgttctttgtataaagaatatggcagagcgtataagaatgcttcttctggcattgtttgatggaaggctgtatcaaatacggctacgttattatcttttaaatgaggaaatgctttaaatgcttcttcaataccgatcaaatgtgcagggttatgaagaggagcaaattcagcagcatctttaataccttggataacttcatcggtaataacaacagatttggtatatttttcacctccatgaacaacacggtgtccaatggctgcgattgaatttttaagatcttcagttaagatagttgaaacgataaagtttaatgcttcactatgtgctgcaccagcacctaaatctgcattacctttctcaccgttaagtttccacttaattcgggcatccggtaggtagaaggcctcggctaaacctgataatttttcagcacctgaaactggatcaagaatagcaaattttaaagatgaactaccgcagttaagaattaggactaatttttgagacatacgagacctattttgaaagttaagttaaaaaataaattcatttactcaacaatattccaagtaaatgaactgacatgaaagtctttgccctgcatagaatacacttttcagataataaaataaattggtaaaatcaaaaaatacgacttttatcaaaaaatgtatcaaactcatcgtttaattttcttgataaaaataatagatttttttataaataattctaaacgaatatgtatcaaacactaaaattaggtcaacgttatttggaaacttggccttcaatacctaaactgagtattatttttcctgaaaatcgagttattaaggtaacattatttgcacaaaaatttatgccgtttttagcagtattttcattagtttggcaacaagtttatataaaacatgatttggttgctttagctattgcagttttaaccgctttgtttgcgttgagcttgccattacaaggtctatattggctaggtaaacgctcaaagttgcctttacctccacaaacaaaggtatggtttgataagatagttgaggtgttacagcaaaaaaatactaatcttgtttctattgagcaaccaacgtatcaggatttggcagagttattgcgtaaggctgaacagaaattagatactgagttttggcagagtatttgagcgaagtttatcgctaaacagcaagtgatatatctaatgggttgaatatagtaaaattttccccgcacttggttatcaagtagcttattttttcactatataaggaaagaaaatgctttgtgctatttacaagactaaaagaaaagaagggatgtatctttatattgaaaaacgggggcattttgattccgttccatcttccttacttgagtcattcggcaagccaatttttgtgatgttatttaatttagcaggacaaaaatcattgattaatgctaacaatgaagatgtgcaacaacaaattaaacaaaatggattttatttgcagatgccaaaacagcaagaaaatttacttgaacaagaaagacagtatcttaagcacaataaatgacataatcaatgatatgattttttaaaatttttaccgcactttgacacttttgaaaaaataaaggcgatcatagatcgccttaaatgtataaattatgctacacagactgtttcggttggtcaaataccgtcactttcggtgcagtttctgtgtatttttccacttgaacaatacatgtattcggggaattaccttgtgctaattttgaagtaccttcatcacgtgtcagtacgttggcacaaccatttttacataaaggttgttctgattgacctaaatcagccggatcataccaagccccctcatgtaatgcgaccgtacctttaataattccttcagtaactaccgcacctgccaatacttgtcctcttttgttgaaaatacgaacaatatcaccatccatgatgccacgagccattgcatcttctttatgaattagcacaggttcacgatcgtttactgcatattttttccgtaatgatgtgtgagccaattgactgtgtaagcgatagtaaggatgtggtgtaactaatgctaaaggggcttccgtcgttgtattacctgcaaattcttcaggaacaaaccaatatggatgacctttacaatcatcataattcatttttgcgacaacatcagagtaaatttcaatttttcctgatggtgtaccaagtggattcagtaaaggatcattgcggaatgcttcgtaacgtacccatttttttgatttttcagttggtttaaagttaacaggtttattttcttgccagaatttttcaaatttcggcataagtacacgatttttacgtgctgcattaaatgccacgttgtaaaaatcttgcaaccattccatttccgtttttccttcagtaaatttgtcttctactcctgcacgtttggctaattctgcaaaaatatcatagtcatttttcgcttcaaattgtggagggacaacttgtttcattggaaaaatattcatcatggcataatcaccggacatagttaagtcgttacgttcatagctcgttgtggctggtaatacaatatccgccatgcgagcagtcggtgtccagttaacttcattgacaataacagtttcaggtttttgccatgctttcactaatgtatttgtatcttggtgatgaacgaaaggattaccacccgcccaataaattaacttaatgtcaggataggtcactttagagccattataatcaattgtttttccaggattcagcaatacatcagcaatacgtgctaatgggaaagagaattttgatgtatcatccagccatgttttttctccggcttgtactgatggattagctgtaattgaaccaataataccaccgactgcggaaggtgcaccaccattagaataatgataactgaaaccaaatccgcctccaggtaacccaatttgtcccagcatcgccgctaaagtaactaatgtccagtgagtttgttcaccatggcgttgacgttgcataccccaaccgcccattaacatagtacgttttgacgaaaaatcagctgctaactgtttgatgatatctgcaggtaacccacaaattttgcttgcccaatttgcgtctttcggttgaccgtcagtttttcctaataaatattgttcaaatttatcatagccagtagtgtattttttcaagaatgccttatcatgtttatctgtagtaaccaacgtatgtgcaatccccaacattaaaggaacatcggtgcctgtatgcacaggtaaccattctgcatttaagaattcacagctttcacttctaaccggatcgatacaaataatacgtttaccgctttctttcaattttttgaaatattcaataccttgttgatcggtagaagtccatgcaattcgcaaagtcgtaagaggattagccgcccataacacaacaatatctgaactttctaaaacggtttcccagctggtttgttgttcataaacttcaattgtacctaatacatgaggcataattacttgtgccgcacctgttgaatagtcccctttgactccgacaaatccaccggtaacattcatgtaacgctgtaacaaggtacgactggcatgtaatgcacctgaactataccagccataagaaccggcaaaaatactgcctgcaccataagcatcacgaacacgtttcatttcacctgcaactaaatcaaaggctttatcccaagaaacacgaacccattcatcacgtccacgcaaactggtatctttattaccctccaaaaatcctttacgaaccattggatattttacccttgtttcactataaagttggtcagctactacgctttgtaattcattttcgactgaaattggcattgcagatcctgatttaactaccttgccattttctacaactacacctaaagccccccaatgagcagctgttacaacggtatgttgttcagccgccacagctttcgaagctaatgttccgacaacaccgccacttagagatacgccagccacgcctaatgatgaattttttaaaaaatcacggcgacttgtattaactttattttgtgttttcattttaaacctcgttatttactaggctcacaatgaactggtgaaagaaaagacatcgaaacggttagaaaacacaccgcactttctccaacacattgtgaaagttttattttcgacacctttctaaagggagtggcacaaccatttctagttataccatgtgcaacatttgacaatgttacaggcttgcaaccttattttgcaacttaggtcaacaagctcggagtcgtcagttttttcaaaaatttcagcgtttcctttaagtgtagcttaatggcttttttcgccaaaatctttggcattgcgttgtaaatagattgttacagatcgtacgtcatctgctgtcattgatgtacgatctttcatcgaatttacaacaccaatccattgatttgcagtgtaatgatctgccccaattggtgcatgacaaccactacaatgagtttgatttaaattatttccaaactgatttaatgcctctaaattagacgttagtacattttttgccacgtttatttcaaacgtaacctctttccactcagaatctgtgactttgtcatgaacagtttgcaacacgttcacatttttctcaattccatcacctaaagccaacataatgcgttgccctaattgtgcatagactattgtttccgcacctacttgttgccaaccgtgaattgtgccgataatattgtcatcttgcaatttccaatcattcacttctgcaaacggcattaaccgcacttcatcgccttgtgccagctgtgccggactcattgccaaactatataatattttatcggtttgcttaaattctcctgcatgtttagttaattcaccatatgcggctgtatcatcaacctctatttcaggcataaaatgagcaatacctttatggcaatcaatacaagtttgatttgtttcgatgccggttttgtgcattttttgtgctgtcgatgtttgcgaagacatttccattgcttcgaaactatgacaactgcgacaagtggcagaatctgattcttttaaatcttgccaaacggacttcgccatttctaaacgatgcttttcaaatgcttcttcatcaggcaatttatcagtaacataagtatgccaaagatctttcactgcaaagacttttgttttcacataatggaaaacgttatcttgcgggatatggcaatccgcacattcggcacgaatcccttttcggttagagaaatgtatagaggcttcccattctgcttgaggttgttgcattgaatggcaagaaacgcaaaattcagtggtgctggttgctttcattgcatactgtactcccgctaaaataatcacccctaataacataccaacgattccactaaacagccattttttatttgattttgccattcgcttttcccccaaaaataaaattcaataaatcaattacaacaaaaaaatcatactcttatattgtaacgatatgatgttggtaattcactaggcacacacgaaaaataacggctatttgcaccgctcttgacgtagatcaatatttaaatttaagagtgaatatgtgaaataaaatgcgtaattttaggtggcatttttagtattttctcccataaattgaaaggattgatatggtacaattttattttttatcttatatagaggaaaaggataggttcttttttgtgccactattaaggttaaaggagaaaagcaatcttgttgttttttttcactcaaattgacttgatcgagtatttcaaaatttaataattttatccaatcaaggatacgccaagtgaaatattgtttaaagggaagtgcggtttgatttttatgatttaaattttgtttgaaaatcaatgggctataagggttaaataaggaaataaagagataaccgtcattttctaaaaccctggctatttcacctaataattgatgggaatgttgcgtgaagtttaatgtattggctaatacacaagcgtgaatagattgttgtacaaaaggaagttgtaatggatcagcttgtatcagactaatttcttctgttacgttttgattagccggaaaaagtgcggtaggatttttcgtcatttccggcatgaggattattttgtggcgtaaaggtaaattgagttctaattctgcacttaatccgccaatcatgagccactgatcgcctaagactttttgaaaccaatctgcaaaaaattcgttgattaggctacaatacattgttcctttttggatatgttgccaactcatcggcaatcgataattttttactgattttatgttgaatttcatattttctaacttgataccctttggaggagcttgatgttaattcctattcctgcacttaatgataactatatttgggtgtataaacgagagaatttatctgtaattgtgatcgatataccggaaatagctgcattatctcaatttatacaggcacaaaatttagtgattgtagctttgctgatcacacataaccatagggatcatattggtgctttggctgaatttaagcagttttatcctcatgttcatatttatggtccggcagaatgtgccgatcaaggggtgacacaagtcattgatgcaggaaggttaattattgatgaatatcatatagatgtattaccgaccggcgggcatacggcacagcatcttagttttttggtagatggtcatttattttgtggagatactttattttctgccggttgcgggcgtgtttttacgggagactattcgcaaatgtttacttctttacagttactcaaatccttgccggatgaaacaatagtttgcccagctcatgaatatacgttaggcaatttagcgtttgctttaactacaggcaaaaataaaagtgcggttcaaaagcaacttgaaaaagtaaaaaaactaagagcagaaaataagcccagtttgccgacaacattagcattagaaaaacaaattaacccatttttgcaagttgagggccttgaggaatttattgagttgcgtaaagcaaaagatatgttttaacctaaattggcaattctattgtattgatagacaatcgaatttgctcaatgtgagacaatttattagaatagcgacgttttttacatgaatttcccaacaataaattatttatgaccattcttgttctcggtattaatcataaaactgcgtctgttgcactacgagagaaagttgctttttctgaagaaaagcacttgttggcattgaagcaaattaaacaaactcagctggcagaatgtgcggtgattttatcaacttgcaatcgaacggaagtgtatttacataataaaaatgttggacctcaaaatgatgaagtctggttagatagttgtgttcaatggtttgcagatatccatcaagtagatttagaagaactgaaaagttgtttatatagtcagcagaatttacaagcatctcgtcatttaatgcgagttgcttccggtttagattctttgattctcggtgagccgcaaattttaggtcaagtaaaacaggcctatcaaatgagtgaagagtattattcactgcattctgatattggcatgatgagtactgagttatctcgcttatttcaaaaaacttttgctacggcaaaacgagttcgtactaaaactcatattggagaaagtgcggtatcggttgcttatgcagcctgtagtttagctcgtcaaatttttgatagcttacgcaatttgaatattttgcttgtgggtgccggagaaaccattgaattagtcagccgtcatttattgcgtcatggagtgaacggcttagctattgctaaccgtacgttatctcgtgcggaaaaattggtggaaaaactggaaacaacacaaaagatagatatttttagtttagacagactttcggaagggttaaagagagcagatattgttattacctctaccggcagtcctcatgttttaatctcccgaaacttgattgaacaggcgcagcaaatgcgtcattacaaaccaatgctgattgttgatattgcggttcctcgtgatgtggaggaaagtgcgggggaaattgaatctgtatatcattacactgtagatgatctacataatattattcaacataacatcaaccaacgtgaacaagcttctcaacaagctgaacatattattcagcaagaaagtgcagatttctttgaatggcttaaagtacatcaattttctaatttgattcgcaattatcgagaaagtgcggagataattagacaagatttactcgaaaaagccttgcaggctctgcaaaatggtgagaatacagagcaagttttacaagagttgagtcacaaactgactaagaagctgatccatcaacctactcaagctatgcaaacgatggtaaaagccggtaatacagaaggtttacaggctttttctcatgcagttaagtcctaggaaagtacaatttatttaagtttatccagttttgccaataaaataggtgctggttgttgttgaattttatacatacgccaaagcagtaaaatagcagcgattgttaaactcactacaaaagatacccaaaagccggcagcaccgatacttggaataatccagtcagttcttgataaggaaaatcctaacggcatgccaatgccccaataacaaaaaagggtaatgtataaaatagcttgtgtatctttgtatccccgtaatgcaccactggaaactacttgagctgtatccgaaaattgataaagtgcgacgagcatcagcagactacttgatatagcaatcacttctttatcatttacaaaaattgatgctatttcatagcggaagaaaaagatgatggatgccgtcaggaaagcaatagataaacctacagtaagagcagagaaagatatctgcttggcattatctattttgccttcgcctagacgttgaccaacaagaatagtagtagccatacctaaagacataggtaacataaatgcaaaggaactggtatttagtgcaatttgatggcttgctacaacttgagtaccgagaggtgataataatagtgaggtaagtgcaaataatgccacttcacaacataaagaaaccgcaataggcaatcctaaacgaaataattttgccaaagttttcgtatcaggtttttcaaataaatgttcaaaaaccttgagatcacgttgatttctagcatgcttactatagacgatcatcattaagcacattatccagttgacaatagctgttgcaatgccacaaccaaccgctccaaacgccggaatacctaatttgccgtaaataaaaatatagtttagagggatattgcacagtaagccaaaaaatgtaatcaccatagccggttttgttttggcaatgccgtcatttaagcaacggaagttaattaataataaataaccaggtaatccccataacattgcacgcaaataaccgatggtaatattggcaagtttttcttccattttcatatactgaatgacaaaatcgctattgtagattaataagccaagaggaatacagctaataaaaacaatccataagccttggcgtatttgatgagcaatatgatctcgttgcccggaaccatttaaataagagattgttggaggcaaggcaagtaataagccatgtccaaataatactaggggtaaccaaatagatgccccaactgcaacggcagccatatcagctgcactaacacgtccagccattattgtatctactaatcccatggaattttgtgctacttgtgcaagtaaaataggggtagcgatggcaattaattttttagcttctgtgtgatattgttgaaaacgagttaatttcataaaaatccgattttgctataatattggaaatatttatttagagagaactttatatgtttacaggaattgtccaaggaacagcacaaattcagtctattattgagaaagctaattttagaacacaggtaattaaaatgccacaggatttattagcaaatttagaaattggtgcatctattgcaaataatggtgtttgtttaacggttacagaaattaagggtgatttgattagcttcgacttaatggcggaaacattacgtattacaaatttaggtaatttagcggtaggcgattttgttaatgttgaacgtgcaatgaaaatgggggatgaaattggcgggcatattttatctggtcatgtttattgcactgcaacaatccaaaatcgtattcaagcagagaataatttgcaaatttggtttgaaatgcctacagctgaattaatgaaatatgtgttaactaaaggatttattgctattgatggaattagtttaaccgttggcgaagtcaaagggcagtgcttttgtgtgaatttaattcctgaaacaattaaccgcactttgattgcaaaatatgatataggtgatttagtcaatattgaaatagattctcaaacacaggcggttgtggacacagtagaacgctacttggcaaacagataaattcattttgcctaaaatctaaaattgtgggagtgtactctcacaattttatctatttatagcgtttttttgtgctttgctcatctaaattatgcaatcgtgctaatttttctttaagttgaatttccagtccacgatctgtaggaaaataaaatttcgtattttttaattcttctggaaaataaatttctcctgctgcataggcattaggttcatcatgagcataacgatattctgctccatatcccaactctttcattaaatgagttggtgcattacgtaaatgtaccggtacatcataatccggcatttcttttgcgagtttttttgcttgtttaaaggcaacatatacagcgttactttttggtgcaacagctaaatatacaatcgcttgtgcgatagcacgttctccttcagctgcaccaactcgagtaaaacaatcccatgctgcaagtgctacttgcattgctctcggatcggcattccctacgtcttcggaggcaatagctaataaacgccttgcaacatagagaggatcacctccggcagtaataattctagcataccaatataaagcagcatcgggagcggagccacgaatagatttatgtagagcggaaattagatcataaaagcgatccccttgcttgtcgaagcgagcctgtcgttcccctaatacttcggttaggagatgatgattaatcaatttccctttttctgtttcatctgccatatccaccatgagttctaaacaatttagtgctaaacgggcatccccattgacatattcagctaaggtttcaagaacattttcagcgaaaatcaaccgctcttttcccaatccttgctctgcatcttggatagcattttgtaacactgtcacaatattagatgtagttaaaggtttcaaaatataaactttgacacgagagagtaacgcattatttaattcaaatgatggattttctgtggttgcacctataaaaatgatagtgccattttcaatatggggcaaaaaagcatcttgttggcttttattaaaacggtgaacttcatcaacaaataaaatagtttgttgacccattaaacgattttgttttgcccgttcaacactttcccgaatctctttcactccggcggtaactgcagaaatacgctcaacttgagcatgaatttgttgtgcaataatctctgccagcgttgtttttcctgtaccaggcgggccccaaaaaatcatagaatgaatatgtccgttttcaatggctttatatagtggctttccagctccgattaaatgttcttggccacaatattgcttcagtgtttgcggtctcatttttgcggctaacggttgaaatgccgagtgagagaaatcaagtgaaaagctggacatacaaaactccattaaatgattaaaagtggacgtttattgcgtccaatcatttcaattttaattaattattttttacgttgatcgtcaaattcaacgcccttaggcaaggtaaatgtgaatattgcatcatttaaggctggattggtaatcttacgcagaatatacaagttactttgcccatcgttctctattgtactaaaattttttaatacaccatctttttcaattcgaatattaaattgcttgatggtacttttcttagatttgggtttaataataaacgtatcggatttttgctcaacaatatattgttgccaatgacttggattattacttgttagcaaaacaaagggggtatcgcttaaggtatcttcaacccaatttgctgttacttgctcaacaaaaggatcgtagaaccataatgtttttccatctgcaataatttgactttcttgaggtgtttcattgtccatacgaaataaattaggacgtttgagttgtatttttccactaccttgctgtattttttttccctgtgcatcagtcacttgttgtgtatagtcagcacttaacacatcaattttatttaaacgattttgtaactcattaaccgcatttgcccaagttacattactgatacctactaataaaagtgcggttaaatttagatattttttcattatttgtccttttcaattgagaatgaattgattcgatataatcaaaaggctgaaatgttgtataacatatcataaaagataagtataaaccctaaaaaataaataatattccgttcagtttatgatactgtgatctagtgcaaagaaaaatttttttcgctagctataatacaacttggtagtttaacagtttatttgaggagtatttcttatgcaaaattgggcacctgaagtatggcaaagtgcattaattggtttatgtattggagtttttataggttacttattattgcgtttcactaaaggaacggtcaaaaaacagataaaaacagaggctgagttggagcaagtgaaaattcaacttaacaatcagaaacgacaattagagcaacattttgctgaaagtgcagagttgttaaaaaatattgcacaggattatcaaaaactttatttacatttagctaattcatctacaacactattgcctgaattggcacagaaagaattattttcaccgcatttattagccacggaatctatttcgtcacaacaagataaatcaaaagataatcagcctagagattattctgagggttcatcaggtattcttaaagctgaaaaataactatttctaaataggcacattgaggtgcctattttgctgtttttctttaatctctttgaatttctgaaacttttttgtattttttctgtcttaaattagcgatatatatgatttaaatggagaaaaaagtgaaaaaatctagctttgttttaaccggtattgctttagggttaagtgttctaacaacatcaattaatgttcaagcaagtttgcctatggcagttgatggacaatctcttccaagcttagcaccaatgttacaaaaagttttacccgcagtagtttctattgcggtagaagggaaacaaaaaaatgatttttctttcaataatgaaattcccgaagagtttcgccgtttttttggtgacagctttggttttgaaggatttagcagtcgtgcaccgcgtagttttcgtggtattggatccggagtgattattgatgcagaaaaaggttatgtattgacaaataatcacgtgattgatcaggctgataaaatcacggtcaaattagaagatgggcgtgaatttaaggcaaaggttcttggcaaggatgatatgtcggatattgcacttattcaattagaaaatcctaaaaatctgaccgcagttaagatcgctgattctgataaattaagagtcggggattttacagttgctatcggtaatccattcggtttggggcaaaccgcaacatcgggaattgtttcggcattagggcgttcaacaggatttgatagcggagcttatgagaactatattcaaactgatgctgccgtaaatagaggtaattccggaggaccattagtaaatttaaatggtgagcttatagggattaatactgctattatttctccaagtggcggaaatgcgggaattgcatttgcgattccaagtaatatggcaatcagtttagttaagcaaattattgaatttggcgaagttcgtcgaggattactcggtattaaaggaggtgaattgaatgccaacttagcaaaagaattcaatattgatgtacaacaaggtgcgtttgtgagtgaagtattgccaaattcagcggcagaaaaagccggacttcaagcgggtgatgtgattacggcaattgatggacaaaaactggcaagttttgcggagttgcgtgcaaaaattgcaacaagtggtgccggtaaagaaattaaattgacctatttacgtgacggtaaatcgaaaactgcgaaagtgaaattgcaatctgatgatggagatacaatttctgcagttggcaacatttctatattagaaggtgcggaattaagtaattataatcaaaaaggcacaaaaggcgttgaaattaaagaagttaaatcaagatctcttgctgctcaatatggtttagaaaaaggcgatattattattggagtgaaccgccataaagtagaaaatttatctgatttacgtaaaattttaggcaaaaaaccttcagctattgccttgaacattttacgagataacagtcgtttttatttattaatccaataattttactgaacctataattcttattaagataaaacgaaatccgcactttaaagattgaccgatcaaaatgcggattttttgtgtttaaagatgatgttcttgtctaatttttttgagtaacgcatcgcagcatttatccagtaattgataagtctgctgaaaattgccggtataccaaggatctggaatatgatcacaagctaaatcttcacatatcgtggttatttgaaaaagtttagatggtgctttcgtaaagaatttttccaaatcatgtagattgttgttatccattgcgattaaataatcaaattgttgccaatcactattgcgaatttttcggctggtaaaccctctgttatcaatagcatatttggtaagaatctttgccgtttcttggtgcatattttctccatcatgccaaccggaagttcctgcactatctgtaaaaatttgattatctaaatgagctaatcgaattttttcacgcataatatattctgccattggggagcgacagatattacctaaacagacaaataaaattttaatttgtggtttcatgttaagcctttgccttatgatgaataaaagtgcggttgtaattgtacatgttttgtgccaatttagataagtttttattagcaataatctatggtaatattcgcttcccctttattttaaaagtgactaatcatgtctttaccaaaatatgttgaacaactgttaaaagagaaaagtaatgttcgggtattctcgtttaaatatgatgggaaatcttattggctaaaacaaaccgaaaaactttcttttatttggcggttcttgaaatccaatccagcggaaatgttaaaaagtgaaattattcgcttacaagaacttaataaaaaatcagcacctgtacctaagttagttttatttggtgataacttttttgtgactgaagatgtgggaagtagtgcaaatacttgggttgaaaatgaggatttatctattgaattaagaaataaggttttgtttgattgtgctcaagcattggcaagtttacataaacaaaatattactcatggtcgcccagccttgagagacatgatttggtgtgaagaaaaagttatttttgttgattttgaatgtacctcgtcaagtaataacatagattggcaaaaaattcgtgatggattagtttttattcatagcttaggacgttcttcaactgtttcggatgagcaaatagcattgactgttactcattatcgtcagtattgtgatgctgatatttggcagaaaactgctgatttcatctataaatatcgttgggcatattatgttcttcgtattttcaaacctgttgcaagaatggatttaattgctatttatcgtttatttgaagctattttaaaaaatcaggaaacattatgataaaaaaaagtgattgtatggagtatttgtgcggtttggtaatggcagtttaagtgttaggggcatagtaatagtattcgattttttattaaattgtttataacatcaacaaataacaataaattagtaattttatcttgctattttttttatgacagatataatgtgtcgcatatttcggacgcggggtggagcagcttggtagctcgtcgggctcataacccgaaggtcgttggttcaaatccagcccccgcaaccactttacatagaagttttcgtaaaggaccccactgtgacttggggtttttttatgcgagtaaacttgagatttagtaaacgggctgatagccctttttttacatctgtttgttatgaaatgtagaaaaaaactcaatcttacgtgttattttgagaggagaggatagtggcaacattagaggataaattacaagaattattacaaccttcagtagaggatttaggttgtgaactttggggtattgaatgccaacgttccggacgtttttttacagtacgtttatatattgataaaaaagatggcggtgtaacggttgatgattgtgctgatgtcagtcgtcaagtaagtgcggtgctggatgtggaagatcctattgcggataaatataatttggaagtgtcttcgccaggcttaaatcgaccattgtttacattaaaacaatttgagaattatatcggacaggatatttctgttcatttacgtgttcctatgcttgaccgtcgtaaatggcaaggtaagttagagaaaattgaaaatgatatgctgactttgattgttgataatcagccacaagtattagtttttggcaatattcaaaaagccaatgttgttcccaaattcaattaattagagagacaaaaatgagtaaagaaattttattagccgctgaagcggtttccaatgaaaaattgttaccccgtgagaaaatttttgaagcattggaaagtgcaattgcactttcgacgaagaaaaaatatgaacaagaaattgatgttcgtgtagtcatcaatactaaaaccggtgagttttctacttttcgtcgttggttagtggttgaaacagtactcaatccaacgaaagagattacattagaagcagctcaatttgaagatccggaaataaaattaggtgactatattgaagatgaaattgattcgattgcttttgatcgcattgcgatgcaaacagcacgtcaagtaattagtaccaaaattcgtgaagcagagcgtaataaaattgtggaacagttccgttcacaggaaggtgaaattgtttccggtacagtgaaaaaagtaaatcgtgattctattattttagatttaagtcaacaggctgaagctgttattttgcgtgaagatatgttaccgcgtgaaaatttccgtccgggtgatagagttcgtggtgtactatacaaagtaagtccggaaaacaagggtattcaattgtttgtgactcgtgctaaacctgaaatgttagtggagttgttccgtattgaagttcctgaaatcggcgaagagttgattgaaattaaaggtgcctcacgtgatccgggattacgtgcaaaaattgctgtcaaaagcaatgataagcgaattgatccggttggagcttgtgtcggtatgcgtggctctcgagttcaagcaattaccaatgaattggggggagagcgtgtagatattgtgttatgggatgataatcctgcacaatttgtcattaatgcaatggcaccggcagatgtgagctcaattgttgttgatgaagataatcattctatggatattgccgttgaaccggaaaatttagcacaagctattggacgcaatggtcaaaatgtacgtttagcaacacagttaactggttgggtcttaaatgttatgacaatagatgatttaaatgctaaacaccaagcggaagataacaagattttagctttatttatgaccgcactagagattgatgaggagttcgctcatatccttgttgatgaaggattcactaatttggaagagattgcttatgttgctgtaaacgaattaacggcaattgatggcttagaagatgaggatcttgttgaggaattacaagctcgagcgaaaaatgcgattactgcaaggatgttagctgaagaagaagcattgaaacaagcccatgttgaagaaaaattattaaatttagaaggtatgtctcgtcatattgcatttagattatcagaaaaacaaattacaactcttgaagaattagctgaacaaggtgttgatgatttatcagatattgaagaattaagtgctgaacaagctgcagatttaattatggctgcacgtaatatttgttggttcaattaggaataaagagtaataagattatggcagatgaaataaaaaaagaaaatgcacccaaaaagttgagtattcaacgtcgaacaaaaactacagtgagtggaacaagtacaacgggaaaaagtaaagaggttcaggttgaggtgcgtaaaaagcgtacagttactaccgatcttgaacgtaaagctcaagaacaagccaaattaaaagccaaagaggaagcagagaaaagagctgctgaggaaaagcttgctgaaaaagcgaagcgagaagcggaaaaagctaaagctgagcaaataaagatagagaaagctaaggctgaacaagctaaagcaagtaagaaaaacgttgatgtagaaaaagaaaaacgtcgagcggaagaggctgaattacgtcgtaaagccgatgaattggctcgtcagaaggcagaagaaaaagcacaaaaagcggctgaagaagctaaacgttacgctgattttgatgatagtgacaatgataacggtaagttggatgattatagcgattatcacttaacttccagctatgcacttgaggcagaaaatgaagaagaacgtcgtaatgaaaatcgcggacgtagtaaaaataaagtagttaaagctaagaaaggtggacgagatgatgaaaatggtaataaaaatgaacgtcaatcagatcgccgtaaccaaaaagatgtaaaaggtaagggaaagcacgctaaaaaggccagtgcgttacagcaagcatttactaaacctgctcaagttgctaaagctgacgtagtgattggtgaaactattactgtggctgagcttgcagcaaaaatggcagttaaggcaacagaaattatcaaaaccatgatgaaaatgggagaaatggtgacgatcaatcaagtgatcgatcaagatactgcacagcttgtagctgaggaaatgggacacaaagttattctacgaaaagagaatgaacttgaagaaatggtcatggaggatcgtgatgtaaatgctgaaaaagttcatcgtgcaccggtggttactattatgggacacgttgaccatggtaaaacttcattacttgattatatccgcaaagcaaaagttgctgcaggtgaagcgggaggtattacccagcatattggtgcttatcatgttgaaactaatgatggcaaaatgatcacctttttggatacgccggggcatgctgcatttacttctatgcgtgctcgtggtgcgaaagcaacggacatagttgttttggtagttgcggcagatgatggtgtgatgcctcaaactattgaagcgatccaacatgctaaagccgccaatgcaccattggtggtcgctgtaaacaaaattgataagccagaagcaaaccctgatcgagtagagcaagaattactgcaacacgaagtgatttcagagaaatttggtggagatgttcaatttgttccggtttctgcgaaaaaaggcttaggtattgatgatttattggaagcaattttgctccaatcagaagtcttagaattaaccgccgttaaagatggcatggcaagcggtgttgtcattgaatcttatttggataaaggtcgtggtccggtagcaactattttagttcaatccggtacattaaaccgtggtgacattgtactgtgtggttttgaatatggtcgtgtgcgtgcaatgcgtgatgaaaatggtaaagatattcaatcggcaggtccatcaattcctgtagaagtactaggtctttcaggtgttccggcagcaggcgatgaagcaacagtcgtgcgtgatgagaaaaaagctcgtgaggttgctctttatcgtcaaggtaaattccgtgaagtgaaattagctcgtcagcaaaaagcgaaactggaaaacatgtttagcaatatggcagaaggtgatgttgcagagttgaatgttattgttaaagcggatgtacaaggttctgtggaagccattgttcaagcattacatgaattatcaacggcagaagtaaaagtaaaagttgtgggttccggagtgggaggaatcactgaaactgatgcaactcttgcagctgcttcaaatgcgattatggttggtttcaatgttcgtgctgatgcaacagctcgtcgtgtaattgaaaatgaaaatattgatttacgttattattcaataatttatgaattactaaatgaaatcaaagcggcaatgagcggtatgttacagccggaatttaaacaagaaattatcggcttggctgaggtgcgggatgtattccgtcatccgaaattcggtgcaattgccggttgtatggtaactgaagggctggttaaacgtaacaacccaatccgtgtattacgtgataacgtggtaatttttgaaggagaacttgaatctcttcgtcgttttaaagatgatgtcagtgaagtacgtagtggtatggaatgcggcattggcgtaaaaaattacaatgatgttaaagtcggcgatcaaattgaagtctttgaagtagtggaagttaaaagagcgatttaatttgtaaccggtaatataattttgttggttgaattatagctaaagagcgagattatcatatattaagttgcttaatgtttttgtggataagaatgcccttaactttgttttttaaggttaagggcattggagttttatcatgttttagaagagcaactgcgtatagtggtaaaaattaggaaaactcaccgctctttttaaggtgtaatttctcaactctagagtgaatttaccaacattaatggagaaaaatatggcaagagaatttaaacgtagcgatagagtagcacaagaaatacaaaaagaagtagcagttattttacaacgtgaggttaaagatcctcgtattggtatggtcacggtgtcggatgtggaaatatcaagtgatttagcgtatgcaaaaatatttgtcacttttttatttgatcaggataaaaatgttattgagcaaggtatgaagggattggaaaaagccagtccctatattcgtagcttattgggcaaagtgatgcgtttgcgtattgtgcctgagttacgctttatttatgaccaatctttagttgatggtatgcgtatgtccaatcttgtgacgaatgttgtgcgtgaagatgaaaagcgtcatgtagaagaataagcgaataaaaatatgagtaaaccacgtaaaaaagggcgtgatatcaacggtatttttttgttggataaatctcaagggatgagttccaatgacattatgcaaaaagttaaacgtcttttccaagcgaataaagcgggacataccggtgccttggatccgctggcaacaggaatgttgccaatttgtttaggtgaggcaacaaaattttcacaatatttacttgatgcggataaacgttatcaagttatcgctaaattaggcgagcgtacagatacttctgatgccgatgggcaagttgtgcaaaagcgagaggtcaatattgatttagcaaaaattttgaccgcacttgagcaatttcgtggtgaaattatgcaagtgcctactatgttttcagcattgaaatatcaaggcaaagctttgtatgaatatgctcgtgcaggcattaccattgagcgtgaagctcgtccaattagtatttttgaattgaagtttattgactatcaaataccttatttaacattggaagtacattgttctaaaggaacttatattagaaccttagtagatgatttaggtgaagtattgggttgtggtgctcatgttactaggttgcgtcggattgctgttgctgattatccttataacaagatgatgacgttagaacaattgcaacaattctctgaacaggaagatttggatttattggatcaacatttgttacctatggaaagtgcggttattcgtttacctggattgcacttaacaaaagaacaggcaagagctgtaggatttggacaacggattaagtttttaaatgaacaaggcatacaaggacaagtgcggttaatttctcctgaaaatttatttttgggtgttgctgttattgatgaaaacagcattgtccatcctcagagaatggttgttattaaacccgaataaatccaaccgcacttaagggcagatttattctgcccttgttttgtcaattaagctaattccgctcgtaattttttagtgaccgacatcatcacttcaagttgtgcaatggtctctgaccagccacgtgttttcaatccacaatctggattgacccataaacgctcttttggtacaacgttaagagctttgcgaagtaaatgttcaatttcttctgctgttggtacacgaggactatgaatatcatacacacccggtccaatatcgtttggatatttgaaatcaccgaaagcggttagtaattccatatcggaacgagaggtttcaatggtgatcacgtccgcatctaaagctgcaatagccggtaaaatatcgttaaattcagagtaacacatatgagtatggatttgtgtatcgtctgctacacccattgagcttaaacgaaatgcctctcccgcccattgtaaataagtatcccaatcggctcgtttgagtggcaatccttcacggatagcgggttcatcaatttggatgactttgattcctgctttttctaaatccaatacttcgtctgaaagtgccacaccaatttgcttacataccgttgaacgtggaatatcgttacgtacgaatgaccactgtagaattgttacaggaccagtgagcatacctttcatcactttcttggttagactttgtgcatattttgaccaacgtactgtcattgctttaggtcgaacaacatcaccataaattacaggcggcttcacacaacgtgatccatagctttgtacccaaccaaatttggtgaaagcaaaaccgtctaataattcaccgaagtattctaccatgtcattacgttccggttcaccatggaccagcacatctaaatccaatttttcttgttcacgcacaacaagttcaatctcttttttcatggaattttcatactcttctaaagagagatcgcctttcttaaacgctgctcgagcacgacgaatttcggtagtttgtggaaacgaaccgatactggttgttggtaagagaggtagatttagccaagcattttgtaatttgatacgttcaccaaaaggtgatttacgttgatcggcattttttggcaaattagctaaacgttcagctacttccggacggtgaatttcttttgaatttgcacgagcatctgctgctacttggcttgcatctaattctacatttaccgcagtacgacctttttcaagagcagtttttaagatgcttaactcttgtactttttgtaaggtgaaagctaaccagctataaagagcagggttgttctcttgtaattgggtttcaacatttaaatcaaatggtgtatggagtaaggaacagcttggagcaatccataaacgctcacccagtttttcttttagtggctctaatacatcaagtacagtatttaagttagctcgccaaatattacgtccgtcaattacgccggcagacaataccttgttgtaatcttcgaatgctactagttgctccggagcacgaactaaatctaagtgtaacccatctactggtaattcttttaataaagtagcgtgttctgttactgaaccgaaataagtagctaataataatttcgcattcactttttcagatagcgttgcgtaaacgtctttgtacgcattaacccactcttttggtaaatctaccgctagtgcaggttcatcaatttggatccactcggcaccttctgccacgagtgcgtttaaaatctctacatacacaggaacaagttgagcgagtaattcaaaacggttaaaggattcgcctttctcttttcctaaccataaaaatgttaaaggcccaacaattacaggtttaacttggtgtcctgcaactttcgcttcacgaatttggtttacataatgtgttgggtttgctttgaattgtgtgtctttatgaaactccggtactaaatagtggtagttggtatcaaaccatttggtcatttcaatggcaaattggtctttgttacctcgtgctaattgaaagtactgatcaagtgtcaaatttttactatcgaaaccgaaacgagcaggaatagctcctgttgcgacttgaagatctaaaatatgatcataaaaggtaaaatcacctactgccacaaaatccgcattagcatcagcttggtgtttccaatttttttcacgtaatgccttagctaaatctaatagatcttgctcagccaactctttacgccagtaacgctcttgagcgaattttagttctcttttggctccaacacgtggaaaacctaaaacgtggaatgttgtcataactaaatctcctgtatggtaagtacaattttgaatagacgtctaaacgtctgtgttttggtataatgcaataaaagtctttaatgatgcaatctcataattttcacgttttgtatgaaaaaaattaataaaagagcggtgtaatttaggtaagattaatagaaaaaagtaatgagcatgaagaggttgttattgatgcgtttttttatgggcttggtttagcctcttcaacaggtgcagatagaacatcccaaatagatggctttggctcttcgggaatgtcattacaaaaaaactgatcgttatttatccaaacaggaagctttttaggacttgagcaattccagtttccataagagtctataccaatccattcaattttagttggtgtttgtggatttaacatttttatttcagcacgagataaataatcttgatagatttttaatgcaccactcgcaccggttaattttgttgttacattatcatctcgccctaaccatacagtaacaacattctcaccatcaataccaacataccaagtatctcttgattcatttgttgtacctgtttttccggcaagtttaagtgaagcatattgattttgtaagctacgagctgtccctcgttcaacgacttgttgcatagcaaataaggtttggaaagctgcttcttggggaacgacttgttgtggcattattgaacgttggtaaatcagattcccctgcttgtctgtaatactgtcaagagttgacaacggaatatgttttccttcattggcaatagtttggaataattctgtaacctcataaggggaaatagagtaactacctaacaaagttgaaggcacgttaggtatttttacattatcccaacccattgccatttgcatttcaattactttgtttaagcctactttcataccaatattaactgttggaatattgagcgagcgaacaagtgcatctattagcatgacggaaccactgtattttctatcgtagttacgaggctgccatggctgagttcctttgatacgaattgtaataggctgattttgaataagcgtattaaggcgaaattgctcaggatcagataacgcagctaagtaaattgacggtttaactaaagaaccaatttggcgacgagcgtgtaaagcacggttaaatcccgcatagtttgtctgtaaaccgccaacaatggcttttacttcacccattttataatcagcaataatcatcgcactttctaaatgtggatttttatattttcgctgtaattctgaaactgcttttatcacggatttttctgcatgttcttgttgtttcggatccaaagtagagaaaattcttgcaccggataaagaggaaagtttgttttcgcccagtttacttcttaattcttgctgtagagtttgaataaatgccggatacttgcggttgatttgtcctcttttttgtacgccgagaggacgtttactgagtaagtcatagagttcattgctaatcattttatgattgagcattaattttaatacaacattacggcgttctaaggccttttgagggttacgccaaggattgtatagtgaaggaccttttaccatgccaaccaacaaggcaatctgatccaaactgatttcccgaacaggtagcccaaaataaaaatggcttgccaattcaaatccatgaatttgtgtgctgccattttgtcccaaataaatttcattaagataggtttctaatatgcgatttttatcgtaacgaaaatctaaaatcaaagccattaatgcttcattcattttacggcttaatgtgcgttcgttgcttaaaaataaatttttaaccagttgttgtgtcagtgtacttccgccttgtacattatgtcctgctttgatgttggtaattaaagcacgaataatgccaagtaaacttattccatcatgttcataaaaatggcgatcttcggttaaaagtaaagtatcgatcaataatcttggataatgttgtagcggaatagctagacgttcttctttatccgattgcaacattgcaataagttttggagcaaggcgaaactcattgatagtttttacattaatcaggtcttcaataatagaaagtttgctatctttatcaaaacgtaggcgaaaaagtcgttgtgcttcaggttgatttgggaaagggaaggctctgcgtaaaataaccaaagtattattttcaattttaaaatcaccgggcgtggcaagcatggtcgtttggcgatattcattttctaacagtgcttgtttgatttgttccagattcagttgatcagataaacgtatgttttcaatacggctataaacctcggcgggtaactgccaaatttgaccatccattttattgcggatttttccgtctaaataaataccgtaaaatgcaattccacataatagagtaaaaccaagttttgcactaaaaataaaaaatcgttgttttttatttttcttttttggttgagttgtatttcgtttttgtttcgcagccatttttatttagtttaagcaataaaagagagataggattttagaaaatattcaaaatcttctaagccacaaaaagcaatactttcttcatcataataatggaaatcagcttccagttcatcgtgttcttcaattgctaaattattggctttaatcataacttcatctgaatgaataaaaacagaaaattcgtttccaatgagactaaactccttttcattgcgtgattgttttgcttgttgcagataattaagtgcggtaggaaccaagtcagaatttaaccgcacttctatattgaaccaattagctattgcctcatgttccatagaaaaattaactgttacttgatcagcgttgtgagtaaattgatagtccattatttagatgctaaaagatgagccacaaccgcaagttgttgatgcatttggattgttcacaataaatcttgagccttctaaaccttcagtatagtccacagtaccaccaactaggtattgtaaactcattggatctacaaccaatttaacgcctgaattttcaacgattaaatcgccgtcattggttttttcatcgaaagtaaagccatattggaaaccactacaccccccaccggtaatataaacacgtaattttaattctgtattttcttcttctgaaattaaggttttgactttattcgccgccgcatcagtaaatgttaaaggaactgcaagatctgccataatattttccgataataaaaattgatgggttattatctaataaccaactaaaccattcaagatttataaaaaatttaatgttataatatgcgacaaattttatgtttagagaagatattatggcgattccattaagaacagaacaagaaattataaagttacgtacagcctgtaaattggcggccgatgtattggttatgattgaaccttatgttaaggcaggcattacaaccggtgagttagatcgtatttgtcatgaatatattgtgaacgaacaaaaggcgattcccgcctgtttaggctattacggctttccgaaagcaacttgtatttcattgaatgaagttgtttgtcatggtattccgactgaaggcaaaaagttaaaaaatggtgatattgtaaacattgatgttacggtgattaaagacggctactacggcgataactcaaaaatgtatattgtcggtgaaaccaatatccgcagtaaaaaattagttgaggcggcacaagaggcattatatgttggtttacgagtggtgaagccgggggttcgtttaaatgaaattggtagagcagtgcaaaaatataccgagagtcaaggtttcagtgtggtgcgtgagtattgtggacatggcatcggtaccgaatttcattgtgatcctcaagtgttacattattatgctgatgatggtggtgttattttacgggagggtatggtttttactattgaacctatgattaatgcgggcaaaaaagaagtgcgtttgatgggggacggttggacagtaaaaaccaaagatcgtagccattctgcccaatatgagcatcaacttgttgtaacgaaagatggttgtgaagtgatgacgattcgtgaggaagaagaaaaagtcggacgaattagtagaataatggttaatatatagtatcaattcaacgtgcaatcttttcaaggttgcatttcttttatttcaggacatgctatgttttcttatcttccaattccaaacccaacgatagcaacaataaaagcacaaaaagaacagcttaaacagtttgagttgacatattttcagcgattttctgttgatcagcttattcataatcgttcagtattttgtgatcaattattaattcatttatggcaattttttcaatttgagcaaaatcatttagcccttattgctgtaggcggttatggacgggaagaactttttcctttatcggatcttgatgttttgttgttagttgaagatgaacctactatcgagctggaggaaaaaattgcacatttttttcggtttctatgggattgtggatttgaggttgggcattcagtacgcactttagcccaatgtgaacaaagtggacgagaagacatcaccattgcgaccaacttattagaaagccgatatttatgtgggcaacaagatttattcgaaaaattaaccgcacttttgcaacaaaaaaatttttggcgaaatgaggatttttttaatgctaaagttgcagaaaaagttacacgctatcagcgttaccataataccggttataaccttgaacctgatttaaagtatagtccaggaggattgcgtgatttacatcttatttattggttggctttaaagcatataggtgctaaaaatttagaagatattttgcacgctggttttatttatccacaagaatattctttattaaagcaaagtcagcaatttttatttcaagtgcggtttgctttacatttaattttaaaacgttatgacaatcgcctgttatttgatcgtcagcttaaagtttgtgaattattaggttttgttggtgagggcaatcaaaaggttgagaaaatgatgaaagtcttttttcaagcttcacaatctatttctgtattaagtgatattttggttaaacattaccaagagcattttttagccggttcacaaattattgagcaacaagttttagattccgatttttatcttatcaataatgcaatttgtgtaaaaaatcctgatatatttattcaaatgccggataaaatattgatgctattttactatttgacacaacactctcatgttgaaattcattctgcaacattacgcaagttgtatattgttactcaacaatttactgggaatttatctgattttcctcttgcaagagaacgttttttacgtttattttcacaacctaattctatttctcgtgctttgttaccgatgcataaatgcggtgtattgaacatttatttaccacaatggaaagggattaacggattgatgcagtttgatttatttcattcttatactgttgatgaacatactttgcgagtgatgttaaaattagaagagtttttagcggaagaggcgaaaaaaaattatccgatctgccacaccattttctcatcattaactgaccgcactttattatatcttgccgctttatttcatgatattgcaaaaggcagaggaggggatcatgctgaattaggtgcagttgatatgcgtatttttgcacaacaacatggctttgatagtcgagaaagtgaaactatggcatggcttgtacagcgacatttgcttatgtctgttactgcacagcgtcgagatattcatgatcctgaggttattctcaattttgctgaagaagtacaaaataaagtgcggttagattatttaacttgtttgactgtggctgatatttgtgcaacgaatgaaactttatggaatagttggaaaagatccttatttacgactttataccaatacagcctagatcagtttcaacaaggaatagatattttattaaatcatcaagaaaaagctgaagaaaaccgcaaacaagcgtgtattttattacaacaaaagtatggatttttatctgaagctcaaattgagcagcactggcaagattttccttgtgagtatttttggcgtaatagcccgaagcaaattgcttggcattctgagttgttacttgataataatcaagatttattgattaaagtcagtaatcgtttttcttatgcagggacagaaatttttatttattgccaagatcaagcgaatttattttataaagttgccagcattattggagcaaagaaattgagtattcatggagcacaaattatcacaggaaaaaatggctatgtattcgatagtttgattgttaccgagttggatgggggcttgctgaacaatgatcgtcgccgtcaattggaaggtgcattaattaaaggattaaaaacaaacaagattgttaacccagttcgtataaataaccataaattacaacatttccatgttaaaacagaagtcagatttttaaatgttcataagcaagaacaaactgaaatggagctttgtgctttagatagagcaggtttattagcagaaattagtcaaatatttgtacaattggagttgaacttattaaatgcaaaaatttctacaattggtgaaaaagtagaggattttttcattttaaccaataagaaaaatgtagctttaacggaacaagaaaggttacgtttacaagatcgtattgaaagtaattttagctaaagataaatgtctacattgcatagattttttatgctaaaatccgcaaccgatttattttattgctgaataggaaaaagaatgaaggttttagaaggtatagttacagcacctaatgccaaaattgctgttgttattgcacggtttaatagttttattaatgaaagtttattagagggagcattggacgctctaaaacgtattggtcaagttaaagatgaaaatattactttagttcgtgtaccaggagcttatgaattgcctttaattgctcgtcgtttagccgatagtaaaaaatatgatgccattgtagcgttgggtactgttattcgtggcggtacagcacattttgaatatgtagcaggtgaagcaagcagtggtttagggcaggttgcaatgcaagcggaaattccggttgcatttggagtattgactacagaaaatattgaacaagccattgaacgagcgggaactaaagcaggtaataaaggtgcggaagctgcattagttgcattagagatggtgaatttattagctcaaattgacaaggcatagtagataaaatgacagaaaaagtaaaaaaactatccccacgtcgtcgagcaagggaatgtgcggtacagactttgtattcttgggctatttcaaaaaatgcacctgaagaaatagaattaaatttcattgtggatcaagataatgaaatgaagggcgtagatatgccatatttcagaaaattgtttcgtcaaacagttgaccatgttgaaattgttgatagcataatggcaccttatttagatcgtaataattttgagttagatcctattgaatgtgcaattttgcgtttagctgtttatgaattgaaatttgagttagatgtgccttataaagtggtaatcaatgaagctattgaagtcgctaaagtattcggtgcagaagaaagccataaatatattaatggtgttttagataaaattgcacctgcactttctcgtaaatagataggtttatcataatgagcaatggcgaatttgatattattcaacgctatttcatcggatcaaaacgtccacaacgtaaagatgtgattgtttctatcggtgatgattgtgctattactgaacattatcaaaatcagcgaattgctattacgactgatacgatggtagaaaatgtccattttctgtcttctattaatccttcggatctagcatataaagctgttgcaacaaatttaagcgatcttgctgctatgggggcgactcccgcatggttttctcttgcaatcactttaccttatgttgatgaaaaatggctcaatgaatttagtcaaagtttatttgatgtattggatcattataatgtgtcgcttattggtggagatacaacaaaaggtcccgtatatacaataactattactgcacaaggcattgtacctaaagggaaagcactttgtcgccacagtgcacaagatggtgactggatctatgtttccggcacattaggagacagtgcggcaggattggaattactattaaaaaatacaggggaaacttatagtaaaagtcatcaaagtgcggttgattctgcacaagaatatttaattcaacgccatttacgtccaacccccagagttttgcttggtttggaactagctagtgctgagttggcaaatgctgcgattgatatttctgatggatttattgcagatttaggacatattttacagcgtagtcaatgcggtgcagtgatcgatttagataaattacctttatctgagcaattaatcaaaactgttggtatagagcgagcggagcaatttgctttaactggcggagaagattatgagttgtgctttacagttcctgatcgcaatcttgaaaagttagagcgagctttaacccatattggtgtgaattatagctgtgttggacaaattcgtaataaaaaacgtatcagttttcaacgcagcggtaaaaccgttgagattggttcattactcggctttgatcattttaaataagatttcattatgacaaataatcctttatctcgtatttctttaaccaatcctattcatttttttgcacttggcttaggttcagggcttattcatcctgctcccggaacttggggtacccttgccggattaattgttggttgtttgctattacagataatgtcggtgttttcttttgcaattttcactgcactttgttttttattaggatgctatttgtgtcaacaaacagcggatgatatgggagtacatgatcatggctcaattgtgtgggatgagttcgtcggtatttttaccgtgttactcgctattcctgaattatcattgatatggtgtagtattgctttcgttgtattccgtatttttgatattttaaagccttatcctattcgttattttgatcacaggttagaaagtggcttcggtattatgttagatgatgttttagctgctatttatacggtcataagcatttctatcttaaattatcttgtatagaggcgattgattatgctgaatttattattggttaatttattcgggttacttaccccgggacctgattttttttacataagtcgtttagcagctagtcattctaagagaaatgccatttgtgctgcgtttggtattagcttgggttgtttagtttggtcaacttcagcaattcttggactggctgttttattgacatcttacccaagtttgcaaggcattattatgatgttaggtggcggatatttggcttaccttggtgtattaatggtgaaaagtcataacaatattgtctttgataatcgtgaacaagcagaaaatttaagaaacagtatgggtaaagaaatcttaaaaggattactgattaatttatctaatgcaaaggctattatcttctttagtagcgtgatgtcttttgtattggttgatttaactgaaacatggcagattattaccgcacttattttattaactcttgaagtatttttgtatttttcttttattgcacttattttttctcgtaaaaccgtaaaaaaattttatagccaatatagccattatattgataactttgcagggatcttttttctttgttttggcggttatttaatttatagtggtcttttcttaggatttggcaattgataaatagagagggataaaatgacgttaaaaattggtattgttggttcgggtggtcgtatggggcgtcaactgatacaggcagtatatcatactgaaggtgtagaacttggtgcggcatttgagcgtgttggttcatctttagttggaactgatgcgggagaactggctggaataggtaggattggtattaaagtaaccgataatttaactcaagaaaaaggtaactttgacatattaattgattttactcgaccggaaggtaccattcagcatttagcattttgtgtagaacatcataaaaatatagttatcggtacaacagggtttgatgatcaatccaaacaagctattcaacaagcggcacagaatattgcgattgtttttgcctctaattatagtgtgggcgttaatttagtttttaaactgttagagaaagcggctaaggtcatgggcgattattgcgatattgagattattgaagctcatcatcgtcataaagtagatgcaccttccggtactgcactatctatgggggaacatattgccaaaacgttaggcagagatttaaaaacgcatggcgtgttttctcgggaaggtattacaggtgaacgtaagccggatgaaattgggttctcaacaattcgtgcggcggatgttgttggtgagcatacagtatggtttgcggatatcggtgaacgagtagaaatatctcataaagcctccagtcgaatgacttttgctaatggtgctgtaagggctgcaaaatggctttctactaagcaagaggggctttttgatatgacagatgtactggatttaaataatctgtaagtgcggttagatttggttcttgaaaattgcacatctttgatctttcagtattcgtcatttaagatgttgctaagatgttgatggaataaaatcaatgccaaaattttagccaatccgaaaaatgggtataatgcccactgatattatatattttaggaatagtagtatgaaatttatttcatttaatattaatgggttaagagcaagacctcatcaacttgacaggattgtagagaaatatcagcctgatgttattgggttacaggaaattaaagtgtctgatgaagactttccctatcatcttgttgaacatttaggttaccatatttatcatcatgggcaaaaagggcattatggtgttgctttgttattgaaacaagaacctaaggtaattcgtagaggcttttctactgacgatgaaaatgcacaaaagcgtataattatggcggatttagaaacagattttgggttgctaacagtaattaatggttattttccgcaaggtgaaaaccgcctgcatgaaacaaagttcccagccaaagaaaaattttatgcggatctgcaacattatgtagagcaagagcatgacagaaataatccaattttaattatgggagatatgaatatcagcccgacagatttagatattggtattggtgaagaaaatcgaaaacgttggttgcgtacaggaaaatgctcatttttaccggaagaaagagaatggataaatcgtctatataattatgggctgattgatacatttcgtcataaaaatccgacaatcaatgatcaattttcatggtttgattaccgctcaaaaggctttgatgataatagagggttacgaattgatcatattttagtgaatcaattattattagaacgttgcgttgatgccggtatagcttttgatattagagcgatggaaaaaccatctgatcatgctccgatttgggcggaatttaagtgaggaacatagaatgggaattgaacaagaatggcaaaattatcgatctaaaattaatgataaattagccgtattttcagttaatttaaaacttcttgaacaatttccagtcgtaaatcatatatgtgaaattgttgtccattttgaagtcccttatatttcagatgcacaaggcttaccgcaaatagaaagttacgccggtttgcaacaagatttgctcaaaatatccagtttaatttctgcccaacctaatgtttattacgcaggcaatattctttgtaatggcaatgctacattgtatttctattgtaatgatgctttagatattacagatgtattatctgataattttccaaacgctgtaaatattgagaaacaattcgattcaacgtgggatctatattttgattttttgatggcatctcaggcagatttgaaagtaaatgcagcagaagaattattggcaactttaattgaaaagggagaagatatctcgaaaagttatcaaattgagcatactttttacttttacaaagaaaatgatctttacttatttttggagaatattgctacttctgacatatcatttttatcgctaaaacattcttctaagcaaataagtgtgaatggatataatgtatatattgctaaaatagagcaagaattgtatttaaatgataccagtatttatcaatatataagaaattttgaagaacttgctttgcaacattcaggtgaatatattggttgggagagcgaagatattggtataaataaaaatcaactaaattaatttttaaatttaaaaaaccttacaacagaataagatgtaaggtttttaatcggattaaagcaccttgacaatactttcacataaataacgaatattattttcagttacaccggctaaattaatacgtcctgaacgcacagcataaatggcaaattcttcttttaagcgatccacctgttctgcatttagaccactaaaagagaacataccattttgttcaataatgaagctaaagtcttgcttggcaccatattcttttaataattcaacgaattgataacgcatatgtttaatgcgattacgcatttcggttaattcggattcccattgttgacgcaataggttatcacctaaaatgatagaaacagctgtagcaccatgagaagctgggttagagtagagagtacgaataattgatttcacttgtgttaatgctattgctgaaatttcttctgtttctgctactaaagtaaacgcaccaacacgttcattgtataaaccaaagtttttggaataagaacttgcgactaataattctttatgattttctgcaaaagttcgcaaaccaacagcatcttcttctaacccgttagcaagaccttgataagcaaaatcaaagagcggtaaccaaccatttttttctgacatttctgctagtattttccattgctcaggggttggatcaatacccgttgggttatgacaacaaccatgtaataacaccacatcgccttcactggcattgcttaagtcagcaattaaattatcccaatctaaagcttttttctctgcatcgtagtaacgatattcacggattgtcatacctacagcgttgaaaatagcattatggtttggccaagttggtgaactaatccaaacgttttgagatgtggtttgacgtttgataaattcggcagcaatgcgtaacgcaccggttcctcctaaactttgtactgttttagcacgtccttgtttaataattttagaatttgtaccaaataataattctttagtgtatgaattaaattctgcaataccatcaatagttaaatagtttttagtggtttctaattcaaatagacgattttcagcttctttaacagctttcataatgggggtgttaccattagcatctttatagaccccaatacccaagttaattttattggcacgtgtttcagatttaaaagcctcacctaaacctaaaattggatcagcgggtgcagcattaatattctcgaacatagtagtatcctcaataaatagttgtgtttgaatagatttctttatactggtaaaaacttatctttgcaaccctttagctaagttaaatttaattatttaattttaactttataaaatatattaaaaattatttgctagattaaattatttcaatttttccaatgcccaatctaaaccaaattgataatcttgcggtagtatgtagcgtaatttttgtaaattatctattaaaatagatggagttggatgagataaattaagatgcccaactttacgaccttctcgtacttcttttccataccaatgtaattgtgaaaatggcaaatttaaccattgtggattatgttcagtgccaattaaattcaccataaccgacggcatagctacttgtaaatcaggcgtaggtaaatctaataacgcacgaagatgtaattcaaattggctaatcgaacaacctaattgcgtccaatgtccgctattatgtactcttggtgccaattcattggctaataattgatcttgcacaacaaaacattccattgccattacgccaacataatctaatttatccataattttagccaacattatttcggcttgtttttgttgttgtgactgttgtggaaaatttaaattcatgacactgtaacgtaaaataccattctgttgcagattatgcgtaacaggataaaaacgagttttgccatttttaaaccttgcaccaaccaaagaaatttcataatcaaaaggaataaatttttcggcaataacttcgccaaaaagctcattgccgattacatcttgattgtttttatctacaatccattgtcctcgtccgtcgtaacctcccatgcgacgttttacaacaactttttcaccaatttctgtaaaaatagtgaaaaaatcctccgcactttgtaccaacctccaaggggaagtaggaatatttagtgcgttaagcaaggttttttgtgtaaaacgatctgctgtagtggcaaaaattttttgattaataaatttatcgtgattagccaacatttctgtaaggggtgttttttcccaacgctcaatttctgctgtaataatactgtcagcaggcaaatcaaaaacaggtgcatcaaaagcaagaggttggacattaatatctaaaggtgcacccgcataacgcaacattctgcccaattgcccattacctaaaacatacactgtaggatataaagtgcggtttaccattaaatgatccttatacttaattaagatattgtaaatttttatttactctgattttacttgatgaggttttagtagtaactcatcttcgttcaatttaaataattttgctattgtatcacgataggatatttctaaagtttctcggctggttgccgttacaccttgatcaattaagaaaccgtcgttaacatcataaatccagccatgcaaagaaagtttttttccacttttccaagctgatttaacaatagatgagctgcctaagttatacacttgttccgcaacattaattcttgtcaacatatcagcgcgtttttcaggagataacttacccaataaatgaccatgtttaaaccaaatatcacgaatatgtaacaaccagttattaatcaatcccagatcttgatccaccatagctgctttaatcccaccgcagttggtatgcccacaaataataatatgctcaatatttagcacatcaacagcatattgcaccacagataaacaatttaaatcagtatgaataacttgatttgctacattcctatgcacaaataattcaccgggttttaaatttgtcaaattttcagcaggaacacgactatcggaacaaccaatccataaatagctaggtgtttgattttctgctaacgctttaaaatactcagcattttcttctttcatcctatttgcccaactaaaattattggcaaataactgttcaatttttttcatttttttaccgctcctaaagatgcacagtatagcctagaatagaaaaacggtaaaataaaaagccctgtaagataacagggcggcgaaatttaggtaggattgaatatcatcacaacaatgtcgcttgtttcattttttgcacgaattctgccaattcggagaggcatttttcttgatctgtgagatttcgttcaataatttgcactatagctgaacctgaaattgcaccggcaacgcctgattttaacgcatctttaacttgttgtggttgagctataccaaaaccttgtaaaatcggagctgagccatatttttttaagcctttgatgagattagctagatttttcgcactttgttgattttcagcacttgttacgccagatcgagaaactaaataaatgtagcctttgcttttttccgccactgctttaagggttgtttcatctgcattgggtggacagataaaaaccggttgaatgtcatatttttgagcggattgaatatacggttcagaagcaagcagaggaatatcagccaccaataccgcatcaactccgacttcagcacagcgttgataaaatccatctaaagtttgagcataaattaagttggcacaaaggagtagactgatcggaatatcgggatatttggaccgcactttggcaattagttgaaaactttcttttgtactgcagcctgcgtttaaagcacgatgattagcagcttgaataaccgaaccgtcaagtaaaggatcggagaaaggaaacccaagttctaaagcatctgcaccgttatccactaaggtacaaataatttcaaaagagcggtcgaaatttggatcgcataaagtaacaaaaggaacaaaagcaccttgtttttgcttttgtagttgtaaaaatttttgttcaaaatatcccatcagataattcctttctcggttaaaattttatctacagtaaaaatatctttatcgcctcgacctgataaatttactacaagtaattgttctttttccggattttgtacaatgatttttaaagcataagccaaagcatgtgagctttctaaagcaggaataataccttcatgtttggctagggcttgaaatgcctcaattgcttcatcgtcagtaatactttcatattgagctcgcccaatagtatgtaaataggcgtgttcaggaccaacggatggaaagtctaagccggcggaaatagaataagattcctcaatttgtccgtcttgagtttgcataatcggggatttcataccaaagtaaatgccaatggagccatgacgaagtggtgctccatgctttcctgtatgaataccgttgccggcaggttcaattccaataagttgtactgatttttctgcaataaactcagcaaacataccaattgcgtttgaacctccacctactgcggcaataacagcatcaggtaagcgattttccttagctaaaatttgacgtttagtctcttcaccaatcattttttgaaattctcgcacaatagtcgggaatgggtgcggtcctgctgctgtacctaataaataatgggttgtctcataattagctgaccaatcacgcatagcctcacaacaagcatcttttaatgagcaagaacctttttcaacaggaataacttcggcacccattaaacgcatacgaaatacattcggcgattgacgttcaacatcttttgctcccatgtaaactcggcaaggcatatccaacatggcacaagctaaagctgtggctacaccgtgttgccccgcaccggtttccgcaataatacgtgtttttcccatacgttttgctagcaaaatttgccctaatacttgattggttttatgtgccccgccgtgaagtaaatcttcacgttttaaatacaattttgtttttgtacctttagtgaggttgcgacataaagttaacgctgttggacgacccgcataatttttaagcaaatcttgaaattcttgctgaaacacaggatcgtgctgtgcttcaacaaaagccttttctaattgttttagtaccggtaccagaatttccggtacatacattccaccaaattcgccaaaatagggatttaaaattgtacccgtcatattttttccttattgattttggattttgtcaaaaactgtttgtaattttatttgatcttttatgccgttggcacattcaacacctgaatttaaatcaatccctagacaatgttgttgcaatgcttgttcaatattttgaatatttattccaccggcaagcatgactttgtatttaatggagggaggaatataattccagttaaaagtttgtcctgtaccaccttgtcgattatctgccttactatcaaaaacataacgatctacataaggaatttcttcaaaatctaccgcacttttcccttgttcatattgctcggtaacgtcaatcgtaacagctttccaaatttgacattgtgtaggtagaacttggcgaagtgcggtaataaattcagcattttcatcaccatgtaactgcacggcgaacaattgtaattgtgtagcgatgttatggataaacgcaatagactgattttggaaaacgccaacaaaaagcaaaggtgcttgcttaaccaatttctgtgcttgacatagggagagtttacgaggagaactttcagcaaaaatcaatccgccgtataaagcaccttgagcatagcttgctttgacatcttgtccacgtgttaaaccacaaactttgtgttcacccaaaagtaccgaacgtacggcattgttaagatctttaccactagttaaactgctaccgattaaaaagccatgtacataaggttttaattgttgtacttgttgatgagaagaaatacctgactcgctgatcacaatgcgatctgccggaatttgtcttgccaaaggaggcgtgcggttaagatctacggagagatcgtgtaaatttcgattattaattccaattacttttgcacccagttttatggctcgatctaattccttttggttggatgtctcagttaaaacgcccattccaaggttatgtgcaagatcagataaagtgcggtaagtttcatcatcaagtatcgacaacatcaataaaattccatcagcttgataataacgtgctaaatacacttgatatttactcagtataaaatccttacaaagaacaggttgagtagccttcttacgtactaagggcaagtagttaaaatctccttggaaatatttttcatctgttaaaacagaaatgaccgaagcataatttttatagacatttgcaatttctactatattaaaatcagaacgaattaaacctttcgaaggtgatgcttttttgcactctaaaatgaaagcggggcgttgatgtgagccttggcttaacacttgataaaaagagcggtcggaatttttaatttcttgctgaaaatgagcaagaggaaatgcagcttgtttttctgcgatccatcgttttttatcttgtacaattttttgcaaaatagaggggatattgggttgcatgataattcctatttattgatacagttttaattggtttaatgtttcaaatgctttaccgtttgccataatatttaaggctttttctgcattggctttaatatcatcattgccaaataacttcattaataaagcagtattcatagcaacagcttgattatgctcatctttacctttcccttgtaaaagtgcggtcaatattttggcattttcttctgctgtaccgccacgtaacgtttctaatggtttaggagtaaaaccaaagtcatgaggtgttaaactataatattcaatttttccatgacaaatttccgcaacatcggtttttccatgaatagcaacttcatctaaaccggaaccatgaataacgatactatgctgatgccctagtcttaatgcactttcagcatagattttaagtaagtgcggtgtataaacccccagtagttgatgttttgggcgagcgggattgcataaaggacctaaaatattgaaaatcgtgcgtgtttttaatatttgtcgtacaggtgcgacatgtttaaatcctagatgatattgttgtgcccagagaaaacaaaggttgagattatctagggcttgtttggacttttcagcagataagtcaatttttatccctaaagcatttaatacatcacttgcaccgcttttgctggatacacttcgattaccatgttttgccactttgtatcctaatgttgcagcaacaattgccgcagtagttgaaatattgatggtattagcattatcacctcccgttccgacaatatcggcaaaagggtagtctatgaatggaaatggcttagcgttggcaataatggcttttactgcaccgctaatttcatctgtttgttcaccacgaaattttaaggcgataagtacgcctgcaagttgttcattagaaagttgtccttgaataatataatgaaataactgttgtatttgttcttggtttaaatgttgtccgtcgaaaagttgactgattaattgttctgtttgcatgttgttttccttcttatttttcgttctattttgacgtcggtaaatcataaataattatattgttctctactttgagccaataaccattgaatactttgctctaataactgtgagccttgcttcgttaatatactttcagggtgaaattgaaaactgcaaataggcaaggttttatggcggatagccataatgatgcccttatattcagcattaataataaactcttccgaaatttttcttcccattaaagaatgataacgagcaactggcataggattatctaacccctgaaacatcatttggttatcatgataaatatttgatactttcccatgtgaaatttcaccggagggaacaacgtctccaccgaatgcttcaatcaaagcctgatgccccaaacaaatgccaatcatagctactttaccttttagtgtttgaattaaaggcaataaaattcccgcctgtgcaggagtacctggacctggtgagagggctaaaacagtctctttttctgctaaaataatttgagttaataactttaaatcgaagttattgcaaaaaacttgtacttgatgccctaaactgcggaattgatctactagattgtaagtaaaggaatcaaagttatctaaaaatataattcttgccatattgtctccttagtcttgagtattggtttgcaatattgcattaatcacagctttagctttgtgacgggtttcatcagcctccatttgtggatcggaatctaagacttcaccacaacctgcttgaatataagcaataccttgttgtacaaaagcggaacgtatcacaatacaggtatcaaaattaccatcagaagataaatatcctattgcaccgccataactatgacgcttttgtttttcaacttggtaaattaattgcattgctttaattttcggggcaccagttaaagttcccatattcatacaagcctgataagcatgaaaggcatcaagctcggggcgtaattttccgactacacgagaaacaaggtgcataatatgagaatagcgatctacttgcattagctccttaacctgtcttgtaccgctttcacagactcgagcaatatcgttacgagcaagatcaacgagcataagatgttctgcgagctctttcttgtctaaacgcaattccaactccaaacgagtatctaattcaggatcgatattaccctgttgatcaaagccacgagaacgagatccagcaatcggataaatttctacttggcgattttcagcattatatttcaatgcactttcaggagaggaaccaaataagatgaaatcggtatcttgcataaaaaacatataaggacttgggttatttttctttaattgacggtagctggccaacgtatttgggcattccagcataaagcgacgagaaggaacaatttggaaaatatttcctgcataaatatgctgttttaattgttcaataatggctttaaaagattcgtcttctaaatttacttgtactaaaacactcgcttttgagacagctaagtgcggttcaattttcgttaatttttgacaaatttccatcgcacttttttgcacattacctaattcttgcgaatgaaaacagaatgattgtagagtagtttgttgtaattgatgatcaatcaccaataaattttctgccaaataaaatacatagtcaggacaggttaatccatcatcttctaggctaatattttccattggtataaaattaattactaaatcataggcaaataatccccctagaaaaatgggtatttttgattgagcataaatatctgttaaacaacgtaagccatcaaaaacggttgttgcctgtaatttgctatcttcatcgagattgggattaatcggagggataataacttctaaatcgctttcagacttcacaagtatttttgctgttggctgtaatttttctctaataagaggtaaaactgtttttccattgctggttaaagcgttaaatataatagtattaccgaaacaagatattttgattgcggaatttacaaacaataggctttttaaactatttttactggagatttccgcactttctaacaacaaagtattagttttttgttgacaaagtgttgcaaaaactgcggtaggatctttgtgataaggtaacttctgagttaatacttcaataaagggggcaaacataaaagaatccttctttagaataaatttaaagatgaactattaaactagtgcaaatttgttttgtcaatagtgaagtagcattattttaaaagtaagtatttgaaataaaaaaagtgcaattttcttgcgagaaagcataagcaataaaattgcacttttaaataaattcgttatgataatcggttcataatttcacttatataaggaagaaaaaatgtggtctgagttattgattggttatggcttgtttattttagaaatactcacaattttattaattgttgcagggatagtgatgatgattatgacactgaaagaacgtaaatcacatcaagtcggagagttggttattacagatttatcacgagaatatgaaaataacagtaaaaaattgcgtgatttttacctgagtgacgatgcgttaaaacaacgtgaaaaagagcagaaaaaagccgataaacttaaagcaaaagaagaaaaagcccaacgtaaaaaaggggaaacgttagcagaaaaaagaaaaccacacctttttgtattgcattttaaaggtgatatttctgcttcagaaaccaccgcacttcgagaagaaattagtgcgattattgcggttgcaaaagaagatgacgaggttttattacgcttagaaagtcccggtggagttgtgcatggctatggattggctgcttctcaattagctcgtttaaaacaacgcaatattaagctaactgtagcagtggacaaagttgctgcaagcggggggtatatgatggcttgtgttgcagataaaattatttccgctccttttgccatcattggatctattggtgttgttgctcaaattcccaatattcatcgcttattaaaaaaacatgatatagacgttgatgtaatgattgctggtgaatataaacgcacaatgaccattttgggtgaaaatacagaaaaaggaaaagcaaaatttcaacaagatctagaagacactcatttattgtttaaacaattcgttacacaaaacagaccgcacttggatattgataaaattgcaacaggtgaacattggttcggcaaacaagcattagcgttacatttagttgatgaaattgcgacaagtgatgatttattgttacaagcaatcaaagataaaacagtgctttcggtaaaatatatgatgaaaaaatcactcattcaaaaattaggcaaacaagcagaagaaagtgctaataatgtgttgttacgattgctgaaacgtgatgagagtactttgatataagcttactcaacattgcccaaaaagagattaaaatttggtttacatttttgttgtttgatattaatatctcaagcagtgctgacgtgatttaatgcgacaatatttttgtaaagatataaaattaaatcgtaagctattcaaaaaatttgaagaaatttatatacataaaattaaggtaaaataatgaaactatcacgttttgtattatctgctgttgtagcagcaacattgtcggcttgtggtaatttaagtaatgtcaccgaacagggtacatcagataacttgaagtggcctaaaattgatcagtcaagatttaatcatgatggtagccaatttggatcgtggccaaactgggataacctacgtatggttgaacgcggaatgaataaagatcaactgtataacctattgggacgtccgcatttttcggaaggtttatatggtgttcgtgagtgggactatgcttttaattatcgtgagaatggtgagcataaaatttgccaatacaaaattttattcgataaaaatatgaatgcccaaaatttctattggtttccaaatggttgtaacggttatgcatcttttagtttaaatacggatctcttatttgattttgatcaagatacgttgacctcaaaaggtgaagaagctgttgataatgttgcaatgcaattagaagcattttcagccaaagaaattaaaattgttggttttactgatcgattgggtacagattcttataacttggatctttctcaacgccgagctgatcgtgttaaagagcgtttaattgaaaaagggttaaatattgatattatcgctattggatatggtaaaacgcaacagattaaggcttgcaatgatgtaccagccaaagaactaaaagattgcttacgtccaaaccgtcgtgttgaaatttcagcatacggaaacatctcaaaaaaatatggtaatggtgagctgaaggggggtacaactggtccatcattatattacgaaaaataatctctcttgatataggtaagggcatcaaacgatgccctttatttatagaattatttatcacttttgtgcaaaatttgattaatcaatttctgagtgagagaaacataactttgctttttattataatagcgatagctgaaattgagcagataatagagctgataaataagttttctttctaagtaaccttcttccagtggatatatttcattatagcgttgataaaaattagttgggaaaggctcaaaaagtgatgaaaaagcaatatcgcattctctatctccccaatagcaagcaggattgcagacaaaaattttatcatctacttgaatacagttttcaatccataaattgccatgcagtatagagggtttggggttatgtttgctcaaagtatctgcaacaatttgcacaatgagatctatatttccaaatatcaaacctttttctttacatacttgcaattgccagccaatacgattttcgctgaaaaatttagcccaacttgtctgccaatcatttggttgataaataggacctagccaagtatcaaaatctaatccatatttatctggtccttgtatttgatgtagctgtgctattttttcagcgaatattgtaaaagaagactgtttattctttgacttatttaacgcttctaacagtaaaaaactatgcccttgtgaattgccaattccataaactaaagggacattaattgaattagttttagctaaaagagctaactggtctgcttctgcacgaaacatagagcggtaggatctttcgtttattttaacaaaaacagtttgaacctcatcattaatcagccaaatttcattcatttcacctgaatataatttttctttatgtttaataaaatagtaggcaccaaattgttctgccagtacctgagaaatagatttccacatagctcctccgatatgattcaagttagcctgactagatgataatctgaataccggtaatattctgtgataaatatcaagttttaataaatatcttattaagtagtgaatttatgtaattcttatctatttatatctttactcatatgttatgtggattgaatatttcagcgaaatgataaggatataccaattagtctagttgttactaatacagtaaaatagatacgttttctaagagttttctgttaaaatgcaccgcacttttattgtacaaggtaggtataaataaaagtgcggtgctttcagcacttttttattttatgtttaacttaatttacaagtaacctttcgtatgggctaccactgtataaggattcacaatgccaattattactttacctgacggttcacaacgtcaattcgataatcccgtttctgtattggaagttgctcaatcaatcggttccggactcgctaaggctactattgccggtcgtgtgaacggcgagcgtcgagatgcctcagatatgattagtgaggatgccaatcttgaaattattactgccaaagatgaagacggtttagagattatccgacactcaacggcacatttattagggcatgctatcaagcaacttttcccaaatgtgaagatggctatcggcccaactattgacaatggtttttattacgacattgatttggaccgctctttaacccaagaagatattgataccctagaaaaacgtatgctggagctggcaaaaacgaattatgacgtgataaaaaaacgtgtcagttggcaagaagcaagagatacttttgaaagtcgtgctgagccttacaaaatagctatcttagatgaaaatattgcaaaagacgaccaacctgcactttatcatcacgaagaatatattgatatgtgtcgtggtccgcacgtacccaatatgcgtttctgtcaccattttaaattaatgaaagtagctggtgcatattggcgtggaaatagtgataataaaatgctccaacgcatttatggtacggcttgggcagataaaaaacaattagccgattatttacatcgattagaagaagctgcaaaacgtgatcatcgtaaaatcggtaaggcgttggatttataccatatgcaagaggaagcacccggtatggtattttggcataatgacggttggacaatcttccgtgagctggaaacatttgtgcgtacaaagttaaaagaatacgattatcaagaagtaaaaggtccatttatgatggatcgtgtgctttgggaacgtacaggacactggcaaaattatgctgatttaatgtttactacacaatctgaaaatagagaatatgccattaagccaatgaattgtcctggacatgttcaaattttcaatcaaggcttgaaatcttatcgtgatttacctattcgtatggctgaatttggttcttgccatcgtaatgaaccatcaggatctttacatggattaatgcgtgtgcgtggttttacacaggatgatgcacatattttctgcacggaagatcaaattgaatcggaagtaacgagctgtattaaaatggtttatgacatttatagtacgtttggctttaccgatatttttgtcaaactttctactcgtcctgaaaaacgcattggtgaagatgctatgtgggatcgtgcagagcaaggtttggcaaatgcacttaaacacaatggtcttgaatatgaaattcaagagggggaaggggcattttatggaccgaaaattgaatttgcattaagagattgtttagatcgtgaatggcaatgcggtacaatccaattagattttgcgttacccggacgtctagatgccacctatgttgcagaagataatgcccgtcgtacacctgtcatgatacatcgtgctatcttaggttcaattgaacgttttatcggtattatcactgaagaatatgcaggttttttccctacgtggttagcaccgattcaagctgttgtgatgaatattactgatagtcaagcggattatgtgcaaaaagtagttaagcaattttctgaagcgggattacgtgtaaaagcggatatacgcaatgaaaaagtcggtttcaaaattcgtgaacataccttacgtcgagtaccttatatgctagtttgcggcgataaagaaattgtggaaaacaagattgcagttcgtacccgtaaagggacggatttaggcacgtttagtgttgaagaatttgttgagattttaaaacaacaagtgagaaaacgtgagttaaccttgttaggtgaataatgataaaaaatataatcggcacttaaaggtgccgattttttatggaattgttcacttaatacagtaatgaatacaacaaacgacgaaatttatttgtaatcggatcgttattaccaatggcagctaaaatcgctaaaaattgttgcttagcctctccatttaacgcattaagatcttgttttaatatatcaaacagcaaatttaatgaagcctcattacgattggcttgatgcaattgtaatgctagttttaatgcaatttctgctgttggatttttagcaaaatcagcttgcaattgctgaatttcaggggtatcagtcgcttttattaaaagctcaatttgagcaactaaaccatgccagcgactatcacgatcttgtagcggaattttatctaaaatctcttgggcgggttcaatgcgttttatcgtaatataggtttcagcgtagagtagagcaatatcgctatttttcttatcagataattcccatgcttctttgagcaacggtagagcgtcattatattgttcttgttccaacaaatttaatgcctgattaaatttcatttcttcttccttcggtaaaattagagataaacgttgttgtaacataatttcatctaaagaaccttggaaagcatctaatacttgtgcttgattaaataaataagttgttggtaatgattgaatatgaaattgtgcggtaagcattttttccgtttcacaattcactttacctaataaaaattgtccttgatatttttctgcataacgagtcaaaagtgcggtaaattctaaagagattttgttacttggggtataaaaaattaaaacaagaggtgtttgtacagaactttgtaatacacttgttagattttgctcattaatatcaataatatatgacataaaatttcctacgtttatttaaaggtaaagtgggtaaattgtaacaaaccaatcattttttgggaaaatatttcttcgatttaagactttcttaatattttttaataatacaaaacagctgataaagaattcggtcaggatgctgaaatagatgtaacagaagtgcagaaattaataaaaaccttggtattgtttgatatgagactgatttaaaacgtcattataaattctccaaaatttaatcgctaaaatagaagatctttgctagaatccgtacgaaaaacacctttctaatgtttttcattttggttattaattcatttggaaacacatataatggaaaatcaatcttttctacaaaaatacttcaagtttaacgaaaaaaagacgactacaaaaacagaaatcattgcgggaattaccacattttttactatggtttatatcgtttttgtcaatccgtcgattttaggtgatgcaggaatggataaacaggttgtctttgtaacgacttgtttaattgccggtttgggaacaattgcaatgggattatttagtaatttacctattgcacttgcaccagcgatgggattgaatgccttttttgcttacgtcgtggtaggaaaactagggtattcttgggaaattggtatggggacaattttctggggatcggtagggttacttttactaactgtctttcaaattcgctattggctgatggcatctattccgctgagtttgcgtgtcggtatcggagctgggataggattttttattgctttaatcggctttaaaaatatgggactggttgtatctaatccggtaacgttggtttcgcttggtgacttacatagctcgcaagttttaatgggggttttgggattttttattattgtagtgttggctgcacgtaatatttattccggagtcttggtttctattgttactattacggctttagcattgatttttgatgaaaatgtggtttttaacggcgttatttctatgcccccaagccttgatgctgtagtcggaaaagttgatgttttaggtgcattagataccgcacttttaggcattattttttcttttttgttagtaaatttatttgattcatccggaactttgcttggtgtaacagataaggctggttttagtgatgctcaaggtcgtttcccaaaaatgaagcaagcgttgtatgtagacagtattagtgctgtaacgggttcttatatcggtacatcggcaatcagcacttatattgaaagtggtgccggagtgtctgtcggaggtcgtaccggaatgaccgctgttgtagtcggaattttatttttacttactattttcttctctccattggctggtatggtgccggcttacgcaacagcaggggcattagtttatgtaggtattttgatggcatcaagcttaattcgagttgaatgggacgatttaactgaagcaacaccagcttttattactgcagcaatgatgccattcacctattcaatcactgaaggtattgcctttggttttattagctattgtgtcatgaagacttgtaccggtcgctggaaagagattaatgcaccggtttgggttgtatctttgctttttgtagcgaaatttgtttgggttggataaatcattaattattgaatagatctttctaaagcggacattagtccgctttcttgttgatttaactagaattttgggatttttatggaacataaattagaagatattatttacatttttaatcgatgctttgagcaagagtataatacaaggttagttaaaggtggtgatgaaccgatttatattccggctaataaagattgctcttataatgctatctatttcgcacgtggtttttatagtagtgctttgcatgagattgcacattggcttattgcaggaaaagagcggcgaaaattagaggattttggttattggtatgagcctgatgggcgttcaatggaaaaacagcgtgaatttgagcaagcagaggtaaaacctcaggcattggaatggattttagcaactgcggcgggatttcgctattttgcgagtagcgataatttaaacggtaatccgggagatacacaagcttttaaattagctgtttatgagcaagttaaaacttatgcacaaaaggggttaccgaaacgagcagaaactttgcgtaaagccttagcggaattttataaaacagaagaccgcattgttctgagtaaatttgacgtagcgaggatataaatgttagctctggaaattaaacatttgacaaaagaatataaaaatggggttaaagcactatccggaattgatcttagggtagaagagggagatttttatgcgttgttgggacataacggtgcaggaaaatcaacaaccattggcattatcagctctttaataaataaaaccagcggaacaataaaagtgtttggttatgatttggatcggcaattagctcaattaaaacggcatattggcttagtaccacaagaatttaactttaatcaatttgaaaaaattcaagacattctagtgaatcaagccggctattatggtattgagcgaaaagaagcacttaagagatctgaaatatggctaaaaaaattagatttatgggaaaagaaagatcaacaagctatgcgtttatcaggtggtatgaaacgtcgcttgatgattgctcgagcattaatgcacaatcctaaattattaattttagatgagcctaccgccggtgttgatattgaactgcgacgtgctatgtggacttttttaaaagaacttaatcaacaaggaacaacgattattttaaccacacattacttagaggaagctgaaaatttatgccgtcatattggcattattcagcaaggtaaactgattgttgatatgtcgataaaagccttattgtcacagttagagacagaaacttttattttagatttagcactttctagttcaacgccaaaggttgataattacaacgtcacaattattgatgagctaacaatggaagttgaagttaagcgtggacaaggactgaataatttatttattcaattaaatggtcaaggaattaatgtattgagcatgcggaataaagccaatcgcttagaggagctgttcatttctatggcgttaaataaaccaaaaatcacggagaaaatataatgttagcttggattgcgtttaaaacaattttaactaaagaaattcgtcgttttactcgtatttgggtacaaactttagtcccaccggtcattacaatgacactttattttattatttttggtcatttgattggagcaagaattggagaaatgaacggctttagctacatgcagtttattgtaccgggattaatcatgatgtctgcgttgactaattcttttgctaatgtggcgtcttcattttacagtaccaaatttgctaaaaatatagaagaattactcatttcacctacttcttctcatattattattttaggatatatggctggtggtatagccagaggtttatgcgttggtattttagtaacaatcgttgctatgttttttgtggaaatgactgtctattcatggctaattattgtgttgacacttttaatgacaacagcaacctttgctttaggtggtttaattaatgctgtttttgcccgctcttttgatgatattagtattattccaactttcgttttaacgcctttaacttatcttggcggtgttttctattctatttctttgttacccgctttttggcaaaacatatctaaactgaatcctattgtttatatgattaatggatttagatatggttttttgggggttagtgacgttggaattcattatactttcactgttctgacattatttattaccgcactttatggcttggcatactatctaattagtcgtggggtagggttaagaaattagccgtcagatcaatacaaacaaaggcgaataatcaatactcgccttacttttatgaacctaagttttttcctttaataaacaaataaatttgcaattgtttatatttgatctatttaggtagttttccttggttttctatttcatagcaaggttcataagcatcacctccaggtaatttcattctgtgctggttgatgaaatcttgcaataaattgtcgactttttccattaatacgggatcaccttttagtttgaattttcctaattctgtaattttatcttgagtatctggtttgatatttcccgctacaattcctgagaaaactcggcgtaaattagcagctaaatcaactttagattggtcaaaatgtaaagctaaatttgccatgttttcatgagttgggataaacggtttttgaaattcagcagtaatttctaatgaccagttgaaataatacgactcatttttttcataacgtgatttttggatgtcgcgcatagcattatttatatggcgagcaactgaaaccggatcatcaatgataattttatataaagattgtgcttcatatcccaatgtatcaccaataaattgatcaatagaagcaaagtaagccgcactttcttttggaccggttaagataagcggaagatgttgggcattattatctggattgagtttaatgcctaaaatataaaggaattcttcaaaagttccaggaccgccggggaaaataataatcccatgtcccatacgcacaaatgcttctagacgtttttcaatatcaggcataataataagttcgttcacaattggatttggaggctcggaagcaataatagatggttctgtaataccaataaaacgactttgtttatagcgttgatttgcatgaccaatggttgcacctttcatgggtgcttccattacacccgctccacagcccgtgataatattcaactcacgatgtccaagttctaaacctacagaacggcaatattgatactctatttggttaattgaatgccctccccagcaaacgactaaatttggttgctcaccgttaattagggccttagcattgcgtaaaatggcgaagacttggttagtgatatgtttactatcttgaatatcacaagggttaatgcgttgatttaatacattaacaaataaaatatcacgtaacacagcgaataaatgatattgaatatttttaatcattttattatcaacaaaagcattttctggtggattatgcaattctaaggcaatgccacgttcttttgctaccaagttaatatcaaaatcaggatatttacttaatagctcacgactgtcatctgtaattgcacccgagtttaatacggctaacgaacaattacgataaagttgataaagtttacttttagcttttttagctagttgttcaacttccatgtgtgaaagttgatccatgcttcctttgggattaacataatgtatatttttcataaaagttcctttttattggcgtgcaagacgctggttaagtggaataggctcaaaattggaacgaaatggattaatatccaatccgcctcttcgtgtatatcgagcataaacactcagtttttcaggttgtgcaaatttcatcagatcacagaaaatacgctctacacattgttcatgaaattcattgtgttgtcgaaaggaaataagataacgcaagagtttttctctgtttatttggttaccaatataatgaatttgcacagttccccaatccggttgattggtaattaggcaatttgatttcagcaaatggctgactaatttttcttcgacccattgcttgttggtgcaattttctaataaatttggatcaaattcatagcatcgtatttcaatatcttgttcatcaatacattcaccttgtagagtagcgatgagttgttgagcataattctgtaacgaatttaaccgcacttttacttgcccttttgcacattttattaaatcttgttgcagtatttgttcaacctgttgtagattttcaaactgactttgattaaaactatttaaataaagtttaaaactttttgattcaatcagattttcactttgataatcaatttcaacatcagcaatagcaacttgaggaacaccttttaaatttagccaagaaatttcataggccgtccaaatatccgcaccgaagctaaagggctgttttgtactaatacctaaatcatctcggttaagtttgcgtggtaccgcttgtaataaagtgtggtcgtaagtagagatatattctgttttttttcctaattttaatgtttgtaaactttggtcatggtattgcatgattcatcctttttgttattgccaatgccaagataaattggaaactaggcgacaatgatcacatttaaaatgaaagagattaaataacggtttatctaaatgccatttttgctgacaattaggacataagcgttgttgttcactttgcagatcatcaccgccaatgcgataaagataataaaaagtgggaataccggtatgtttttcaatttcttgagtcagataatagccgtgtttagttaaatgactattgaaatcactgatttcatacagtgcttgttgctctaaaattgaaccgttcatttgcaattgatcacaagcctgccaattttcttgccatttaataatatccatactcaagtgcggtatgtttttaaattgtttatataatggaatgggcaataaattatcaccgctatgtagcggagaacaagactgcaagtacgttgtatacaacacttgccaagtcgctacctcttttgagtaagttatatctgaatttaaatcatccgcaatgatttgaaaactatcaaaaaaaatccccgcactttttgcttgttcaagggctttatctacttgtatgttattgaatgtaggtaacaaactttgctgttctggacaagttactcgcaatgcaaatccctcttcattattttgaactgcaacaaataatggaatttcacgtccaataatttgtccgttataacgccattgctcaataatttgattaattagataagaaatattactaattggcaatttttgaggttgtcgataggtaaaaaatacttcaactagatacatatttattgtttgatgattattcgaaagggtagattaacataattaatttgcatagaataccgctttttattttggaatataacgcatgaaaattgaaatcaaaacgcacttacaagcgttacaaaaaattatgcaggacttagaattatggcaatcctttccgcccgatgaacaggctttttcaagcaccgcccctttttctatggatactatgagtgctaatgaatggttacagtgggtttttatccctcgtatgtatgcattgctggagggtcaacaatctttaccgtataaaatggcaattacaccttatatcgaagaagcattaaaagatcttgatggattaaatgacctactacagcctattcatgaaattgagaaattatgtcagagccaatagaattggatattttatatcaagatgagtttctcgttgtagtgaataaacctgccggaatgttggttcaccgcagttggctagatcgtcatgaaactcaatttgtcatgcaaactttacgagatcaaattagtcaacatgtttttcctattcatcgtttagatcgtccaacatcaggtgttttactttttgccttaaatgctggaattgctaatttattatgttcacaatttgaattaaaacaagtgaaaaaaagctatttggcgatagttcgtggttatttgagcgatgctcaacgaattgattatccgcttaaagtgcaactggacaaaattgcagataaatttagtcgaaaagaagaactgcaagatgcaataacggattattatggtttaaaaaccgttgaaatgccttatggcgtagggcgttatagctcttcccgctattcacttgtacgtttaatgccttatacgggacgtaagcatcaattacgtcgccatttaaagcatatttttcatcctattttgggtgatactcaatatggtgatttacaccaaaatcgggctttcagtcaaaatcttggtgtaagcaggttaatgttacatgctgaaaaactttgttttcaacatccggtaactaatgaaacaatagaaattgttgctgatttagatgagcaatggaaattgttattcaaaatatttaattggtaaatagctcagaacatttgaggaagtatatgttaaataatgtaaaattaactcatgaagaacagcaaagtgcggtagaaaaaattcaagaattaatgcgacaaggtatgagtagtggggaggctatagccttagttgcgaaggtgttacgtgaaaaaaagttacaccctgaatcaaaatataatgaaattttgtgatctctgtcggatttttgaatattatttattgcaaatatagttaatttcgttgagtatttagttaaattttaggaaggtggtaaggctcacagtcttattatgaagtatagaggtctgtaaaggcttaaaaccaaagaggttaaaatattatggaagtaggtattgttaagtggtttaataatgcaaaaggatttggattcctgtctgttgaaagtagtgatgttgatgtttttgcacattattcagtcattgaaatggaagggtatcgttctttaaaggcgggacagaaagtacaatgtgaagtcgtgcatggagataaaggttctcatgccacaaaaattatccccatggttgaataataaaatcaaagctttttgtttcggtgtattgagcaaggttttaaccttgcttttttatgtgataaaactcgctattttagcagatctttaagaccttctttcataacggaaacttgattttcatataagaccttgctttctctttcatcaatcatataagaaatagtttccgataaagtcattttcattttacgtgaataacgagataatcgaagccagaccgcatattctagatcaattgattttttctttgtagattgtttctcgccattgaaaaaacgttttcttcttgctcttatagcttgatccaacttaataactaaatttgatgacaaatgattttctatccaatcttcaattttttcagggtagttttggtgtgtcattaattgccgaacaatgtcttcttgtaaactttgttctgtataacgtgtaatattttcaccctcgcgtgattttttgatcaaatagatccatttccaatttgcttcttgatttgtcagcttctgatatttcattttgtttactcatctgtgacattgtaacctatgtaataatatacgctttttatattattttctagtaaattttaatcaagaatacagaagtgaattaaatagaaatatgcgataatatgaccttaatcgtttaatttgatagagagtacatgtgacaattgagcaaaaaataaaaaaaagagccgacgaatgcttgtcagaacagttaatttcttggcaaaatttattacccatgttacaacttgataatgattttttagacgcttcattatctgagattgatttttttactttgcaaccaagagctaaaagtgcggttgatcttttcctaaaaaatcctcaacgatcattgcttgttttaaaagcagatgatcaagctgaatatgcaactttactacaagaatatatagaacaaaaacttcctgtttctgaaacaattagtggtgttcagtatattattgaacagggagacagtttttcttttccacaaatcagtctggcacaggcagcatcagtggaagacaactttgcaggaaaacaaaaagtggcgagtgctttatttttcgatcaaagtcagttattcggatcagttgtaattcaccccagttctcatgatattcaacttaattcaggattagtacatcaagtaaataatggtgtattgattttgagtgccggtgcattgttggagcaatttgagatatggcatcgtttaaaacacttattactaacaggtattttcagttggtattctcttaatccttcaaaaaccttaccttgcacaattcctaattatcccctaaatctaaaagttatcattttaggtaatcgttcagagttggcaaccctaggtgaattggaggaggaactgtatcatttcgcagattatgcagaaattgaaagttatttttcgcttaatgatgcacaatctcatcaaaagtgggcaagttatgttcatacgttggcaaaaaaacaaggaattgagctgagtattgaaggaataaatgcactttatcaactttttgtgagagaaagtgaagatcgttacttaattagtatctcaccattaaaattaaaagggatcttatttgacacacaaattttaagtcaaagaaaacatttaagtgcggtagattttcaattattttttcaacaaaaagaacaacagtactgtttcttacgtgagcaggcgtataaaggcattttacaggagcaaatttttattgctacagatggggaaataataggacaaattaacggattatcagtcattgaatatcccggtacgccggtttcttttggcgagccttcaagaataagttgcattgttcaatttggtgatggtgaagtaattgatattgaaagaaaaagtgatctggcagggaatatccatggcaaaagcattatgattgcagaaacttgtcttgccggcattttagatcttccttctcaattgcctttttcagcctcaattgcatttgagcaatcttatggtgatattgatggtgatagtgcgtctttggctgttttctgctcgttattaagtgcgttggctgatttgccgttaccacaaaatattgccgtaacaggtagtattgatcaatttggtttagtgcatgctgttggtggtgttaacgataaaattgaaggcttttttgaagtttgtcagcgtcgtagattaacgggaaagcaaggtgtaattattccaagtgcggtattaaatcaactcagtttatccagtaaagtaatcgaagctgttcaacaagaaaaattctttatttgggcagttgacgatatttttcagactactgaaatcctatttaagcgatatttagtaagcgaacaggatgctggattggaaaaaaatcttcccctcgtagatgtgattcgacaacgattagaagagagatctgaacaacagcataaaggtcgtttttggaactttttctttaatcgccattaaatgttaagaaacacgtgattttttaacaggttagtattattattaggggcattttcgtttaaacattggatttttaattatttagaggacaggtatgtataacctacaagaaattactgaaaaagcccggaaagcaattgaggcactacaagataagagcattgaaagcttagaggcaattcgtgtggaatattttggtaaaaagggacattttacacaattaatgcaagggttacgtgatgtgtcggcagaggaaagaccggcagttggtgcaaaaattaatgaagcgaaacagaaagttcaagcgatattaaatgcaaaaaaagtggaatgggaagaaatagcgttaaatgaaagattagcccaagaacgaattgatgttagtttgccgggaagaaaaatggaactgggagggttacatcctgtttcaattactattaaccgtgttgtacaatttttttcaaaactaggatttactgttgagataggtcctgagattgaaacggattattacaattttgatgcgttaaatattcctaaacatcatcccgccagagctgatcatgatacattttggtttgatgcagaacgcttgttacgtactcaaacttcaggagtacaaattcgtactatggaaaaaatgtgtcctccaattcgtattatggcaccgggcaaagtatatcgtaatgattatgatcaaacgcatacgccaatgtttcaccaaattgaattattgtatgttgataaaaaagctaattttactgaattaaaagggttgttgcatgatttcttgcgagctttctttgaagaagatttacaagtgcggtttcgtccatcttattttccatttacagaaccttcggcagaagtggatgtaatgggaaaaaatggtaaatggcttgaggtgttgggttgtggtatggttcacccgaatgtgttgcgtaatgtaggtattgatccaaatgagtattcagggtttgcagtcggtatgggagtagaacgtttaaccatgttacgctacaacgtcacagatttacgttcattttttgaaaatgacttacgttttttaaaacaatttaaataataagggcaaaaaatatgaaaaaattaatatcggtcgtgttggttatgttttcccctcttacattcgctttttcagagggacaagttaaattgcctgtgcaggaaaaacaaccggcagcaatcattcgtgtatttgataattcggttaaaccctataaaatcattgaaggaaagaaactatctcgtagcaaaccacgtcatctttgtttatatatacttaatgtcgatcttcaggaaagaaatcttttagctcaatatgtacaagctccagcaccgataaaggtaaatgtgccgaatgttaatgctaaagtacgaatggaagataatcagaagaattttttgattatgtttgacatgatgaaaaaagatattagagataatacacctactctatgttgggcacttggtaaagatgaccctatcggcatttacaaattggatgtgcaatttaataatgttgtgtttgaaaacttagaatttgaattattaaaatagagagagaattataaatgaagtttagtgaacaatgggtgcgtgaatgggtaaatcctgcaataagtactgaacagttatgtgaacaaattacaatgttgggcttagaagtagatgatatagcaaaagtcgcagcagatttttcaggggttgtcgttggtgaagttgtagagtgtgctaaacatccggatgcagacaaattacggataaccaaagttaatattggtggcgagcgtttattagatatagtatgtggggcaccgaattgtcgcaaaggattgaaagtcgcttgtgcaatagacggggctatattacctggtaattttaaaattaaaaaaactaaattacgtggtcagccatcggaaggaatgttatgctcctttaacgagcttggtattaatgaggactccagcggtattattgaattaccgcaaaatgcaccgataggtgttaatttacgtgaatatttaactctgaatgataaccatattgaaattagtctaacaccaaatcgtgctgattgtttaagtataaccggaattgctcgtgaaattggtgtagtcaataaacttgaactaaactcaccgcactttgaaccggtcaaagcaagtattaaagataaagtcactattgaagtattagcacctgaggcttgcccacgttatcttttacgtgtggtgaaaaatattaatgttaaagccgacacaccgatgtggttacaagaaaaattgcgtcgttgcggtattcgttcaatcgatcccgtggtggatataactaactatattttgttagaacttgggcaaccaatgcacgcatttgacatggcaaaagtgactcaacctgtacaggttcgtatggcaaagcagggggaggaattggttctattggacggttcaacagcaaaattgaaagaaaatacgctgataatcgcagatcaagaggggccgttagccatggcaggcatctttggcggacaggcaagtggtgttaatgcagaaactaaagatgttattttagaagcggcattttttgcaccattggctattgcaggacgtgcaagacaatacgggttacatacggattcttcacatcgttttgaacgtggtgtggattttgaattggcccataaagcaatggaaagagcaaccgcacttttaattcaaatttgtggcggtgatgccggtgaaatttgtgaggctttaagtgaagcacatttaccaaaagtaaaacaaattcagctacgtcgtacgaaattagatacgttacttggccatcatattgaaacagaaaccgttactgatatattccaacgtttaggatttgcagtggaatatgcgaatgatgtctggacggttacttctgcaagctggcgttttgatattgaaattgaagaagatttaattgaagaggttgcccgtatttatggttacaatgtgattccaaataatgcacctttagcacatctacaaatgaaggaattaccggagaaattattagatctcaatcgtatccgtaccgcacttgtggacagcgactatcaagagattatttcttatagctttgttgatcctgatgtacaaaaattgttacacccagaactggatgcacttgtattgccaaatccgatttcaaaagaaatgtcgacaatgcgattatcgttattgccgggtttgctgagtgcggttgcatataaccaaaatcgacaacaaaatcgaattcgtttatttgaggcaggattacgttttgttcctgatactacagcagaatgcggtattcgccaagaatatgtgattgggggcgtgattgttggtgataaacgtcctgttcattgggaacaaaaaggtgaacatgttgatttctttgatttaaaaggtgatttagaacatattttgtctttaactcacgttggacatcgtttgcgtttcgtggctaaatcttatcctgcactacatcccggacaatcggcagaaattttacttgataacaaagaaattggttttatcggtacagttcatccaaaaattgtacaaaaattggatttgtccggaaaaccgattgtattccaaattgaatggaatgcgatttctgagtgtaatgtccctacagcacaagaaatttctcgcttcccagccaataaacgtgatcttgccattgttgtagacgctgacgttgtggctggagaggtattggaagtttgtcgtgctgttggaggtaaacaactcattaatgtaaatttatttgatgtttatcagggggtaaatctacctgccgataagaaaagtttagcacttagcttaatgattcaagatacagagaagacccttgaagaaaaagatattaatgcggtaatatctgttgtattatctgcgttgcaacaaaattttaatgcttacttgagagattgattatggcactgactaaaattgaacttaaaaatagcttgattgaacagggtttaaataaattagaggcgaagaaagtagtagaaggcttctttgaacaaattcgagtttcattagaaaatggtgaagatgttaagttatccggatttggtaattttgaattaagagataagtcatctcgcccggggcgtaatcctaaaacaggagaagctattcctgtttctgctcgtcgtgtcgttgtattcagaccaggacagaaattacgttcaagagtggaaaaaaccaaacctaaaaattagggattttttgtttctttaagaaaagccgtttacattaagtaaatggcttttatattttaacgtaatagaaaaggtgtaatggacaaaatagttgctaaaaagtgcggtcagtattttatttttttacaccgcactttcttaccttaatttacctctttgaaactaatcatttcgccttgaataaaatctattttttcatcgttttcttgaacgaggggagtaggtgagaacgcttctttatcaaaggcaatatcaccctctattccttccggaatctttccatgtcggatacgtttaaaatcaaataagttagaatcacataaatgtgaaggcacaatattttgtatcgcactaaacatagtttcaatgcgtccgggatattgacgatcccatttttgcaacatttctttgacaacttgacgttgtagatttggttgagaaccacataaattacaaggaataattggaaattgtttggcaactgcatatttttcaatatctttttctttacagtaagccaaaggacgaataacaatctgtttgccatcatcactgatcagttttggcggcatagattttaatttgcccccataaaacatattcaaaaacaaagtttccagcatatcatcacgatgatgtcctaaagcaattttagttgcccccaattctgttgcggtgcggtataaaattcctcgacgtaaacgagaacagagagaacaagtggtttttccctcaggaattttttcttttacaataccatatgtattttctgccacaattttgtaatctacactaatgctttttaaatattcaggcaaaatatgttcaggaaagccaggttgtttttgatccaaattcactgccacaatatcaaaatgaataggtgcattgaggcgtaaatttaataaaatatctaacaaagtataactgtctttaccaccggataggcaaaccatcactttgtctccattttcaatcatattaaagtcagcaatagcgttgcctacattgcgacgtaatcgcttttgtaatttattcaagttataactttgttttttatctttttcggtaatgatatttaaattcatacagtttctgatcttgttaagaatgcgatatagtaaaggggaattgccactttgccaacagaaaactgtgtttttaatgatctattatttaaattaagtacgagataaaagtgcggtagtttttagtcatatatctattagaaaaagcaaaattacgctataatcttgcacaattttgcgtaagttattgcattgtgagaattgttaatgctcgaaacatcacaaactattcctgaattagtcaactggacgagagaacgagagttttctttgagtctatcaacagaacgcttggcgtttttgctggctattgctatttacaataatgaaagacttgacggtgaaatgttggaaactgatctcattgatatttttcgccatatttcaaatacgtttgaacaatccgctgaaactgttagtacaagagcgaataactccatcaatgaattagtgaaacaacgttttttaaatcgctttagtagtgagtttactgaagggttatctatttatcgcttaactcctttaggtgtaggggtatccgattactatattcgccagcgagaattttccgctttacgtttatctgttcagctttctattgtagcagatgaaattcaacgagcttcagaatctgcggaagaaggcggtgatgaacattattggcgtaaaaatgtatttgcaccattgaaatattctgtagcggaaatctttgatagcattgatttatctcaacgtatgatggatgaaaatcaacagcatatcaaagaggaaattgctgaactgcttactaaagattggcaaacggctattgccagttgtgaacgtttattagatgaaacctcggggaatttacgtgaattgcaagatacgctcaatgctgccggcgataaattacagtctcaattgttacgtattcaagactgtgtaatagggcatgacaatttgtattttgttgagcaacttattgtagatttacaagcgaaactcgaccgcattataagctgggggcaacaagctattgatttatggattggttacgatcgccatgtacataaatttatccgtacagccattgatttggataaaaatcgtgtcttttcacagcgtttacgtcagtctattcatcattattttgatcatccttggttcctttggatcgcacaggctgaacgcttaattgatctgagggaagaagaattaacattacgtgaagaagaagcccttggggaactgcctgaagaattgcaatatgaatcccttgctgatttacatgagcaaattgtggaaacaatgcaatctttattaattgaatatcgtctacaaaatacccctattgatttgagtgaggttttgaccgctcaactaaaacaatacccacttgctaaacattttgatatagctcgtattattattgatcaggccgttcgtttaggtttagctcaagatgatttaaacggtatttatcctaattggagatcgattaacgaaaatggtgcagaagtacaggctcatgtaattgataaatattaacccaatttaaccgcactttttgtaactgattaatttaacaactttctgaaaagaaaagagaaaaatatgacagataatattcaagatttactttccattaaattagctagagctattgcaaatcctttattccctgaagtggatagccaattgcgttcaggtaagcacattggacaagagtatttagataattattcatttttggcagattttcaacatgaattagatagtttctaccggcgttataatgtggaattgattcgtgctccggaaggatttttctacttacgtccaaaagcaaccacgttaattgctcgctcagtgttgagtgaattggaaatgttagttggaaaagtgctttgttacttgtatctcagtccggaacgtttggcacaacaagggatttttactgttcaagaagttcatgatgaattgatcaacttggctgatgaaactaagttattgaaagcaattaatttgcgtgcaggtggttctgatttggataaacaaaaattagcggaaaaagttcgttcagctatcagtcgtttacgccgtttaggtatgattcatgcggtaggcgatcaacatagtggtaaatttacgatttctgaatctgtgtttcgtttcggtgcagaagttcgttcaggggacgatccgcttgaggctcaattacgtttaattcgagaaggggaagcagcaacggctcaatcattacaagaagaaaaaaatggcttgaaagataatatggatcaaagtgcggtagaaaatgaacaatattttgaaaatgaagaaaatgaggggattgcataatggtagatttagcgttacagccgaccatgtctgaagaaaacatcgatcaagttgaactacaggataaacaagaatccctcgaaaattttacggcattttcgccttttcgttctcaggggggagtggagcgaggtaagtttcgttctttaaccttaattaactggaacggtttttttgcccgcacttttgatttagatgaattagtaactacgctttcaggcggtaatggtgcaggtaaatctacaacgatggcaggatttgtaactgcacttattccggatttaactttattacatttccgtaacaccactgaagccggtgcaacaagcggttctcgtgataaagggttacatggaaaacttcgccccggagtttgttatgcggttttagatactattaattcacgtcatcaaagaactttagtgggagcaagattacaacaagtggcaggtcgtgataaaaaagtagatattaaaaccttttctgttcaaggcttagcattatcacaaaatccaaccgcacttttcactcaaataattgatgagcgtcaagcgaggatattaaatcttaatgaattaaaagacaaagttgaaaaactcaatgctcaattcaaacaatatcattcaataacagattatcatgcgatgatgtttgatttggggattatcccgaaacgtctgcgttcttcttcagatcgcagtaagttctacaaattaattgaagcatctttgtacgggggtatttcaagtgccattacccgatcattgcgtgattatttattgcctgaaaatttgggggttcgtaaggcttttcaggatatggaatcagctttacgtgaaaaccgtatgaccctagaagccattaagattactcaatctgatcgtgatttatttaagcatttaattactgaaacgactaattatgtagcatcggattatatgcgtaatgtcaatgagcgtttaggtaatattcaacgtgcgattaattttcgtcgagattggtataaagcaaaaggtgagcaatatttatcacaacatcgcttagtggaattgagtaaagaagctgctgatttggctgaaaatgagaaaatcttagaaatagatcatcaaagtgcggtagatcatttgaatttagttctaaatgctttacgtcatcaggaaaaaattgaacgttatcaacaagatgtgcttgaaatcacagaacgtttagatgagcaaactttagtcgtggaaaatgcgaatgagcaggtaattgacactgaagtacagttacagaatgtagaaagtgaattggatcagattcgtaatcaattagcggattataagcaagccttagatgcacaacaaactcgtaatttacaatatcaacaagccatacaagcattagaaaaagctaaacatttatgtggattacctgatttagctgttaaaaatattgacgattatcaccaagagtttgcggttcaagcggatcaattaactgagaatgtactggatcttgagcaaaaaatgtctttgacgcaagttgcaaaaacacaatttgataaagcttatcaattggtatgtaaaattgccggcgaagtacctcgttcagcagcatttgagcaagctaaggaattgttgagagagtatccgacacaaaaaatacaagctcaacaagtctctcaattaagtgctaaattacatgagcttgagcaacgttatcaacagcaacaaagtgcggtacgtttattaaaagaactgaatcagcgtgcggatttacaggtcgatgaagcagaacagttggaagattattatgtagaacaagaaacattgattgaagatttaaccgacaaattatcagagcaaatagaaaaccgctctgtcttgcgtcaaaaaagggagcaactaactgcacttcatcaagaaaatagccaaaaagcaccggcatggctaacagcccaagccgcattggagcgtttacaagaacaaagtggcgaacattttgcagatagccaagatgtcatgaatttcatgcaagcacagttgattaaagaacgcaacttgacgattgaacgtgatcaatttgagcaaaagcgtcagcagttagacattcagatttctcgtttaagtcagccggacggctcagaggatgctcgtttaaatatgctggcggaacgtttcggaggtgtgctgttatctgaattatatgatgatgtacctattgaagatgcaccttatttttctgcgttatatggaccggctcgccacgccattgtagtacgagatataagtgcggtgaaatctcagctggataatttggaagattgccctgaagacttgtatttaattgaaggcgatccaaccgcatttgatgacaatgtattggattcaaaagaattggctcatggggtagttgtacagatttcagatcgtgagttacggtattcgaaattccctgaagttcctttatttggtcgagcggctcgagaaaaacgtttagaagaattaaatattgaacgtgatgaaatttcggaactttatgcacaaagagcttttgatgtacaaaaatgtcaacgtttgcatcagcattttagccagtttgtcgggttgcatttggctttagcatttttacctaatccggaacaaactattgctgaaattaatcagcaacgcaatgaagtagatcgtgaattaaatctacttaacagtacagaacaacaattgcgtcttcaattggatcaagccaaagaaaagtggcaattacttaacaaattaagaccgcactttgctctattggctgaggacagtttaatagatcgtattgaagaatgtcgtgagcaactggattttgcacaacaagatgagttgtttattcgtcagcatggtgcgaatttatcgcaacttgaacctattgtaagtagtttacaaagcgatcctgaacattatgatcgtttaaaagttgattatgaccaagcagttattttgcaaaaaaaagtacagcaatgtttgtttgctttatctgatgtaatgcagcgtaaagctcattttgcctatcaaaatgaagttcaaaccgaaacttctgatttgaatgagaaacttcgtcaacgtttagagaaaacgcaacaacagcgtaatgatttccgtgaaaaattacgtcaaaagcaagaacaatttgcccaatataataaagttttaattgagctgacatcttctttgcataataaacaacaagtactaaatgagttgttacaagaagtaggtgatcttggtgttagagtagttcaaggggcagagcagttggctcaatctcgtagagatgagttatatcaacaactttctatcactcgccaacgtcgcactcatgtcgagaaagaattaactcgaattgaaagcgaatcgcaaagcttgaatacccgtattcgcaaagcggaacgagaatataaggctcaacgtgaaacagtagtagcggcgaaaattagctggtgtgtggtgatgagattatctcgtggcagtgatgtcgaaaaacgtctaaatcgccgtgagtttgcttatttatctgccaatgaattgcgttctatgtcagataaagcccttggtgcattacgtcaagctgtagcggataatgaatatttgcgtgattcattgcgaatttcagaagatagtcgcaaacctgaaaataaagtgcggttctttattgcagtttatcaacatttgcgtgaacgtattcgccaagatattcttaaaacggacgatcctattgatgctattgagcaaatggaaattgaacttaaccgtttaactaacgaactgactcaacgagaacaaaaattagcgattagttcagaaagtgtggcaaatattatgcgtaagacaattcaacgtgaacaaaatcgtattcgtatgctaaatcaaggtctgcaaaatattgcttttggacaagtcaaatctgtgcgtttagtagtgaatattcgtgattctcatgctatgttgctcaatgccttatctaatgaacagaccgaatatcaagaactctttacggatactcgcataaccttctccgaggctattgctaagttatatcaacgccttaatcctcatattgatatagggcaacgtaccgcacaaacgattggtgaagaacttttagattatcgcaattaccttgatttagaagtagaagtctatcgtggtgcggatggctggttacgtgcagaaagcggtgctttatctaccggtgaagctattggtacaggtatgtcaattctcttaatggttgtacaaagctgggaagaagaaagtcgccgtattcgaggaaaagatattattccttgccgtttgttattcctagatgaagcagcacgtttagatggtaaatccatctcaacgttatttgaattgtgtgagcgtttagatatgcaacttctcattgcagcacctgaaaatattagtccggaaaaaggcacaacttacaaattggtgcgtaaaatttcaggcaatcaagaacatgttcatgttgtcggattgcgtggatttggtgcaacagagtagtcaaataaaagaaagtgcggctaaaaataagcaatttttgactgcacttttttgaggaaaataatatatgttggttttcaaaaaagaaaaaaaagaaaagctatctcttttagaggaaataccttttaaattggaaaaggacattcaacgtctttttgaacaaaatctatcagaaatcacatcttatgactttgtcaaatccgaattttcaattaaaaattatcgcattgatacattagcttttgacgaggaaagtaattttttgttattattgaatataaaagaaatcaaaatattagtcttgttgatcagggaatttcttatcttaatttaatgcttgataataaaggtgagtttattcttgaatataatgaaaaaaatgaaacaaaatcattaaaaagaaatgaagtagattggtctcagtcaaaaattatttttgtgtccccatcatttactgatttccaaattcaagctacgaattttaaggatttgcctattgagttatgggaaataaatcaattcaatcaagatattataactatcaaacagattaaaaaatccaaatctgcacctagcgtaaaacagattaaggttacccaagattcatctttagataaattaacgaaagagattaagatttatacagaacaagaacatcttgaaaatcaatctgatgaaataaaagaactctacgatgaatttaagcaagctattttgaaattagatagtgaaatagaaatagttgccaaaaaagtttatatcgcatttaaaaagaaatctaatattgttgatattcaaattaagaagaaaaatttaaaactatggatcaatttatctaaaggaaaactagatgatcctaaaaaactagcagttgaagttgataaaaaagggcatcatggtaatggagattatgaattaaccattaaaaatactgataatattgaatatattatgagtttagttaaacaagctgtttaggagaaataatgcaatatcttattcttgccgttttatgtagtgtttctgtttccattttatttaaattcaccaaaaaatatcaaattgtaaccgcacaaatgattgcatttggttatgtggttgccttgtcattgagctattttttattatcacctaattttaaaggacttacttttaccgaattttttgcacaaagtgaagctaagccgatctttatcagtttagggattttattgcctgtcggttttttagtgatgtcgaaagcagtggagtatggcggtattattcgcacagatgctgcacaacgtttggcattgttcttgcaaattatcgctgcagttgtgattttcggtgaaaccttaagcgatatgcgaattgtcggtatcattgtcgcatttttcgctttatttttcctattaagcaaacctgccggcgggataaaaagtgcggtcaaagccgcttttgctcttgccggcgtttggttaatttggggagcaacagggattttatttaagaaaattgcactaatgggcggtgcatttcctacaaccttgtttatcacttttgtcctagccgccgtgattatgtttatctacctattaatcaaacgcactaattggacagtatccagcctgattggtggcattattttaggttgtttgaatttcggtaatatcctgttttatatctacgcacatcaacatttcaaagaaaatccaaccattgtttttgccacaatggatctcggcgtaatctgtcttggtacactagtcggtgcaactatatttaaagaaaaaatcagcaaattcaatggtattgggatcttattaggtcttgtcgctattttgttgttacgggtttaggggaagattaaatgacaatcagcattcaacaacgttctgaactccatcgccaaatttggcaaattgcaaacgaagttcgtggagccgtagatggttgggattttaaacaatatgtattaggcgcactgttttaccgctttatcagtgaaaattttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcgaaaatggtacagatttaaatgaccttctacctaaaatgagcccgcttaacccacaatataaaatgaaaaaacagacggtgtttgagaagatttccgcctttgtggaaaaatttaaggggattgggggaatgttttaatgaattctacaaagtgcggtaagttttttaaggtttttgtgtatgcaaaatgatttcagtttttttatctacgattacgaaagttttgggattaatcctgccactgacagaccggctcaattcgccggtattcgtacagatcaagattttaatattattggcgagcctgtaatgttttattgtaagcaaaccgatgattatttaccgtcgccggaatcagttttggtaaccggtattacaccgcaaatttgtaatgagaaaggtattcccgaaccggaattcgcagagaaagttttagctgaatttagtcaacccaacacttgtattatggggtataacaatgtccgttatgacgatgagatgacacgttataccttttatcgtaactttattgatccctatgaatacagttggaaaaacggcaattctcgctgggatttaatagatgtagtccgagcttgttacgctttacgtccggatggaataaattgggcttacgatgatgatggaatgccgagttttcgtttggaaaaattaacacaagtaaatgatatagagcatggtaatgctcacgatgcaatggctgacgtctatgccacgattgcaatggcaaaattgattaaacaaaaacaaccaaaactttttcaatttttctttgaaaatagaggaaagagggaagttgagaagttgattgatatcgctaatatgaaacctttagtacatgtatcaggcatgttgggtaattatcgaggtaataccagctgggttgtgccattagcttggcatcctataaatcagaatgctgttattgtttgtgatttagcaaaggatattgatgacttattggctaaaagtgcggtcgaattacgtcaaaatttgtatacaccaaaagttgaattggaacaacataatattttacctgtaccacttaaattagtgcatattaataaatgtcctattcttgctcctgcaaaaacattattgccggaaaatgcaaccaaattgggaattgatcgagaattctgtttgcaaaatttgcaaaaactgcgtcaatctccagatattcgagataaggtcattgaaattttccatgatgaaagagaagtaatacacagtgataatgtagaaactgaattatataagcaatttttcagtaataatgataaaaacaatatgacgattttgcgtcaattatctccggagaaattaaacgagcataatttatctttttcagataaacgtatctcggatttattatttcattatcgagcaagacatttctataaaacgcttgatcgctctgaacagataaaatggcaaaaatatcgccaacgtaaactagaaaaaagtgcggttcaatttgaggaaagtttacaacgtctagtagaagagtatcaaaataatcctgaaaaattattgttgttacaacaagtatatgaatatggagcaactttacttagtaagctatattgataatagcaatatctagaaatgcaggatgaaaaggtatttggtaaataaaataaaagagacaacgtaacagctataattttatttactaaaatttatagaggagaagagggttgaatattttaattgattttgatggtacttgtgtaacgcataattttcctgaaataggcgaagatattggtgctgcacaagtattaagagatttggttaagaatggccataacttgattttattcacaatgagatcggaagattgttatcttgatgaggcattgacatggttcaaaaataatgggattgagttatacgctgttaatatcaatcctgaacaatctaagtttaccagttctcctaaagcctatggagatcttattattgatgatattgcattaggcattccgaaatggtcctgccatttttatcgcccttgtgttgattggaaattggtgtcggaaatgctgtatagtcaaaaattgctaacatttgaacaaatcaataaatatgattttagcatgagaaattatttataattatgaaacgttttaaaagcaacgttcacagctatgcgaggacgttgctttttttgtagcttttatttattaagctttttctccttaagaccacactacaaaactattacaaatcatctctctatttaataaagttaaataataatacctttcaatgtgcaagggagcctttatctgtcttgcttagctggtataactgacttgtgcataagtctgtgatttatttatatcgtagtttttactaaccctataacttattacatataatgtatattatgttaaattaaatgattagatatgtaacttttggactggtttacccccctattttgctatgaaatcttctgttaattagatgagattaaaaaaataaaaacgataaaaataaaagcgagttttttatttttttatatttgatacagcgtcactaaattnnnnnnnnnnnncattaaaaaagccccatgattttcatcatgaggcttaaaattttgaaaactttacttatacacgtttaaaatcaatatggactaattttggcttgaatggatggcgttgcatcgcttgtactttaacagaaatttccttcccttcaataactaggataatagtatccgaatagaaagaatcatgaatttgagcgttatttaattcatcatgatttaatacaattgaaacaggtgcttcactaccaccataaacgatagcagggatttgaccattatgacgcaggcggcggctcgcacccttaccttgcttagaacgaacttcagcgttaaatttaaatgacattttttatgttctcttgaataaaataaaaaaacaaaaaaaccgcaggcgacccagcgatttcccttacgttatgctaaaacttatagtcatgttttagacatggtgctgattataatgagttattctctataaatcaaataaaacattgaatttaaactggatatttctactaaaaaagctaaaatagccgtcatattttcttattataaatggatagttcatggacttattaattaatttttttactgattatgggtattttgcagttttctttgttctcattatctgtggctttggaattcctattccggaggatattactttggtttcagggggggttattgcaggtttataccctaatgaagttaatgttcatatcatgctgattgtgagtatgcttggtgtgttaattggtgacagtacaatgtattggcttggtcgcatttatggggtgaaaatattaagaactcgattaatcaagaaaatagtaacccttaaacgtttaaaaatggtgaaagaaaaatttgctaaatatggcaatagagttttatttgtggcacgttttttacctggtttaagggcaccaatttatatgatatcaggcattactcgtcgtgttagttttattcgttttctcctaattgacttttttgctgcaattatttcagtgcctatttgggtatatttgggtgattttggtgcaagcaatttagactggttacatcaacaaataaagaaaggtcaatttgcaatttatatcttaatacttctactcgcattgttcttattttggaaatggaaacgtagtaagaaaaaagatgtgtaatttagaccatcttacagggcgtatttaattatgccctattttatttacggtatagtgatttgtaaaaaataaccatactcttctactttcgacacactagatatcgtataaaatattggagatatataatttaaaaagggtactataaaaagtaccctaatttatctttaaattaaagcgcagattttgctttctcaaccaatgctgtaaaagcaactttatcaaacacagcaatatcagccaaaatcttacgatcgatctcaacagatgcttttttcaaaccgttgataaatttgctatacgataaaccgttttgacgagtagccgcattgatacgagcaatccatagttgacggaattgacgtttacgttgacggcggtcacggtaagcatattgaccagctttaattactgcttggaatgcaacacgataaacacgtgaacgtgcaccataataacctttagctgccttaagaactttcttatggcgtgctcttgcaataacaccacgtttaacacgagccattatctaatctcctattgtccatgaatcttaaaaaatttaactaatcgtatgattgtgcccaaaacactatttatgcgtatggtaagcacgctactactaaaacttggtctgctttcgcaaccattgatttatgacgtaaatgacgtttacgtttagttgtctttttagtcaaaatgtgacgtaagtgagattgtttacgtttgaaaccacctgaagcagttttcttgaaacgcttagcagcaccacgtaaggttttaattttaggcattgtttataactccgcattgtttaagtttaacatcagataattaggcgaataaaaatacggcaattcataccgcactttactacttgaatttgcactaattatttcttttttggggcaagtaccataatagcttggcgaccttctaatttgccaggtgcagattcaacaacagcaatatcagcaagatcatttttaacacgttctaacatgtctaaaccaatatcttggtgagccatttcacgtccgcgaaaacgaacagtgattttagctttatccccatcctccaaaaagcgaatcaggctgcgtagttttacctgatagtcgccttcgtctgtaccaggacggaatttaatttccttcacttgtacaactttctgctttttcttctgctcttttgcagctttacctttttcataaaggaacttaccgtagttcataatacggcataccggtggttctgcatttggactaatttcaacaaggtctaaatctgcttgctctgctatatttaaagcttgttggatagatacaatacctacttgttcgccatcttggtcaatcaaacgaacttctttcactctaatttcatcattaatacgattagggcgatttgttgccggagctttttttacggttttaataatgttattcctctaacgattttaaactaccatcaaactgcaatactgcagaagacataaacgattgctgtatttttagcaaaaaacggcgagattttataagattttcaattactatgcaaggtattaaggcatatattgacaagttttataaataaatgcacttaataaaatacatagaacgcatagaatttgaataagttttttctttgttagcttttctgccggcataactagtttcctttgcactttttaaatttaaaacttcttaattattttatttaatgttatcatttcttgagttagatcaagttttgcattacacgcttttatctcagtttcaatgcttttgaggaatgaatgaaaacttttccctatgaacaaaaaattggacgacgagttcaatctactggttgtgctattcactgtcaagcttgtagtattagtcaactatgtattccgtttatgtttaatgaacatgaattagatcagcttgataatattattgagcgtaaaaaacctattcaaaaatctcaaattttatttaaagcaggcgatgaactgacttctctctatgctattcgatccggctccattaaaagttatactattggtgaaactggagaagaacaaatcaccgcctttcatttacctggtgatttagtaggatttgatgcgattaatggtatgcgacattttagttttgcacaagctttagaaacatctatggtgtgtgaaattccttttgatattcttgatgatctatcaggaaaaatgccgaaattacgacaacaaataatgcgtttgatgagtcatgaaatcaaaacagatcaagaaatgattttgttattatctaaaatgagtgctgaagaacgtctagcagctttcatccataacctttcaaatcgatactctgctcgtggtttttctgcacgagaatttcgtctaacaatgacccgtagtgatataggtaattatttgggattaactgttgaaacaatcagtcgtttgctgggacgttttcaaaaaaacggtcttttatccgtgcaaggaaaatatattactattaataatatgtcagaactttctacacttgcaggaacgacaaaacctaaaattaaaatgatcggataaaaacttggacgcaataataagttactactttcgatcattttttaaagtacaattacttgtcatttttataaatattgcctattctatttctatagtttgtttccactggaaaaatatgtttattgtttttgcaaaatatcggaggttattatgcaatttaataatatacttgtcgttttaaatcccgaatcagaaaagcaatatgctttggctcgagcagttcgtttggtacaagaacaaaagagcgagaatagagtaagaattacaacttttatgacggtgtatgatttttcttatgaaatgtcaactttgctttcttccaaagaaagagaaacaatgtgtaaaagcattattaagcaacatcagcaagctgttcaaccatatctcgaaaaatatgcggatccgaatattgaatttaattcaattgttctttggcacagtaatgaagcggaagctattacaaatgctgttgcggaacataattatgatcttgtcattaaatatactcaggagaaggaatctttatcggcattaatttttacacctcaagactggcaattactacgcaaatgtcctgcacctattatggtagtacgtgatggaaattggaaacatcaacgtcgaattttggtagcggttaatgtttccaataatcaagaggaatatacttcattaaataatgaacttgtttctttaggaattgatttagcggataaattagaacgaggcaatattcatcttgttaccgcttaccctcccactccaattaatatggcaattgatttacctgaatttacaacaacagaatatggtgatagtgttcgtggacagtatcttttaaatatgaaaacattacgccaacaattttgtatagatgaagaccatactcacgtaagagaaggatttcctgaagatgttattcctgctgtcgcaaaagagctggaggctgaattggttgttttgggaacagtaggaagaacaggactatctgccgcattcttaggaaatacagcagaacatgttattagcaaattagaatgtaacttgttggcaattaaaccgagtaaaaaataacaaaattattacacgaaaatcctaacttaatcgttaggatttttttaaagtaattttaaaaatgagcctacggtatagaatgagccaaatactaaaataatatccttttctgtggcattttgtaccgcactttttactccctcatatacagaagaataagtttgagcagatagctcattagttgttgatatttgttgtaatgtcataaataattcatgactactctgccctcttacgccatctaaggttactaaattccactgatcaacaactttgattaaaggtgataatattccttgactatctttatcttttagaatgccacataccgaaataatttttccgattgatttagctttaagtgcggttaatctttctaataaataggaagctgcatgaggattatgaccaacatcaacaataatttgaggtaattgtttaactgtttttttacttaatttagctaaatttaataatttttccgggttaattttctgaaaacgccctgccagttcaacttctctaagtgacttatgaacaactgatatagaaatatcaaaaggtaaataagccaacgttgctaaagctgttgcagcatttgccaagggaatactacaaataggtaaattatccatataaatagctttatcaccttttattgtttcccatgtccagccattttcctgtttgctgaatttccaatctttattacgacaaaataatattgaatctaattttttcccttgttctaataaagaacagggaatattgttttcaccaataacggcaggcttatttggacgaaaaatacccgatttttcaaaagcgatctcttctcgagtattgcccaagaaatccgtatgatcgatgtcaatactggtaattacggcaagatctgcatcaacaatattagtagcgtccaaacgaccgcctaaccctacttctaaaataacaacatccaaattagcttgcttaaagagatacaaagcagaaagtgtactaaattcaaaataagttaaagattgtgatttatgttgctcaataaaagcaaatgcttgagtatgttcttcatcagctaattcttgattttgaattcttactctctcgttataacgaattaaatgaggagaggaataaacaccaacacgaaatcctgagtttagtaataatatttccagtagacgacatgtcgtcccttttccatttgttcctcccacagtaataacaaaaggagcaagctgtaataaatctaattgttgtgcaactgtcttgaccctatctaatcctaagtcaattgctttagcatgtgctttttctaaaaaacaaagccactgttcaagtggcgatgttgcaaataaatttaaactagacatcatcagatttttcttgaattaattcaggttcaacaaaaggggaaggcatattcatgagcttgcttaaaagattagctaaagtttcacgcatctcagaacgtttaacaatcatatcaatagctccatgctccagtaaaaattcactgcgttgaaaaccctctggtaatttttcacgcacagtctgttcaataacacgaggtccggcaaatccaattaatgctttgggctctgcaatattaatatcacccaacattgcaaaacttgcagacacaccgcctaaagtcggatctgttaatactgaaataaaaggaacacctttttctttcatctttgccaatactgcactggttttagccatttgcattaatgagaacaaagcctcttgcatacgagctccgccacttgccgaaaaacaaactaatggacaatgtaattctattgctttttcagcagcttgaacaaattttgagcctacaacagatcccatagaccctcccataaaactaaaattcaaggcagccacaacaattggcatgccataaagagtggctgaaacagtaatcaacgcatctttttcgcctgtttctttttgtgcggctgacagtctgtctttatatttttttaaatctctaaattttaaaatatctttaggttctaaatctgcagcaatttcaacaatgctatctttatccaataaagcaacaagacgttctcttgcatcaatacgcatatgatgaccgcactttggacaaacttctaaatgacgttttaattcatcacgatacaacacttgctcacaggaagtgcatttggtccataccccttcaggtacatttgattttttgctatttgaagttgtatttttactaaaaattctatcaatccagctcatgtttaaccttttatttattaacttaaaactcgcctcattagaccataagtcgggggaattttccagaatttaacaactccgactagcctattaattcaagcaatttaactgccattaacgctagattaaagtgttgctcatcggctacagaccaaaattctattttattttccgccgcacttaatgtactaatatgcaatttcactttttcctcattgttttcattttctccgtgagtaaccggcgtaattaatttctctgcatgatattgaattagctcattttcttgccaaaaatgtaattggctttctatatcaaccaaataatctgaaagtacggtcacaaactgccccattccataaaatacaggcacttgaatttgatgaaagacaatattctctaattgtgggtaaattttttgtaactgtataactaaattttgagtttgtacaggaaagacatcaaaggctaaacgttgctgttccgtatccagcggaatcccatttaataattgagctgtctgtccggccaatttggcaacttgttctgcttctacataggaagcgggtaataatgaagtcacaaccaattgatgaatgctattaacaatattactgatagctaaagcacattgcgttacttgtggatttggaagggaaacaatatttctttgacgtaattcaatcaattgatcgtcattaatacctggtacaacaactggaatatttgcaaggcttgcacaaatgcccagtacatcgatcacaatacaacctgaatcagctatttttgccaaaagatcaacatgctcaattgtccctgcaaataaaacataattaaactctgtccaatctgcctcttcaggcataatttgaacaactgctttattgttaaaacgaatgctttgctcttctttgaaaggctttatttcaataattgtcaagctttcaatttcaagctgagtgtgttctaaagtttcgacaattttctcagataactcaaattctgctgcaatagcaatacttaacatttttctctcttataaactcggatagaatgcagtgcattttacaaaataattaagggaaaagaaaatgctcctgtaattatttactaggaatattgctcagaaaattaacgcaataaatcccaaacaggacgacaattttccggtaacactagagattttcccaattcaatccaattgcttggaaaatgaaaatcggaaccaacggaactgtataaatcgtaatcttccgcccaacgagcaagtaataaacgttgatccttggtttgtccacaacctgctacttctattgcatccccaccccactgtttaaaatcagcgataagacgttttatcttttttgttgtcatggtatagcgtaatggatgagcaagcactgcaattccgttggcttgatgaataatctctattgcattaggaatatcaacccattgtgttttgacatatgcagattttccttgtgctaagtattttttaaaagcttgactaatgttaataaccttgcctatttgcactaaataacgggcataatgtgctcttgttacttctccatccgtcagtttttgcgtttctgcaaaggcgttggctacacctaaatgctccaattttttcccgatttcaaccgctctttgtaaacgaatttttgcctgctcattcaaaagtgcggtcattttttttgaattttcatcaaaacctaatcctacaatatggatactataattttcccaagaagtagaaatttcaacaccattgatcaatgaaatgcctaattgttctgcttgagtacgagcttgcgataatcctgcaatagtatcatgatctgtcaaggctaaaacatttacaccttgttgatgtgcccttatcactatctcttgtggtgataaggtaccgtcagatatagaactatggcaatgcaaatcataaattttgttcatactttcctaaattacttatcaaaaataaaaagtgcgataaatttcaccgcactttcacttagttatgtgtctgttttcgctattgaagggctttttctattttctcaaacaaatctttcgacaaattttccacttcgcttaagcgaactaaagcacgtttcatcaaagtttgccgttgaggatcaaaacgagagaaacgaattagcggttcaattaagcgtgaagcaacttgaggattactttcatttaaccttaacaggatctcagttaaaaaacgataacctgaaccatcgattgcatgaaatccttttaaattatgtacacaaaagctaccgactaaagctcttaaacggttaggattattaaaattaaaacttggatgttccattaattgttgcacatagtccaaagtattgtcttcaggtcttgtagcttgtaaggcaaaccatttatccataaccaaaccgtcttgttgccatttttgctcaaaatccgctaataattggtctcgacaaggtagttgagcctgtgttgccgattttaaagcatttaaactgtcagtcatgttatttgctttgacataatgtttattcaccaaattgttacctaaatctgtataagccaaataattcaaacagagattacgcaatgctctcaacgcaatatcttgctcagttacttgatatgtctctaactgaatttcattataaattttcaagaataactctttcaaattatttgcaatatggcattgcataaattctcgcactgcataaataccgtccggatcgatcgttttgaataattcggcaaattcagtttcttttggcagtgttaaaatcgttgttactaaaccaatatcttgctggtaattttctaatacttgataaagtgcggtaagaatttcagcagaaaactccagtgccagtccttgttgataatgaattaagttacgtcgtaactctgcattaaataacatttgagccgcatcccaacggataaaatcatttccagcaaatttcaacagtatgattaattgttgtgtattataagcataatctaattttaccggtgcggaaaaatcacacaataacgctggtacaggacgtgtataaatgtgttgaaattcaaaaagttgttctttttgtgtaagatttaatacgtcagaaagatctttgccatcagcctgtaaaaattgctccacaccgctttcatcgtataaagcgatttttattggaatatgtaaattgactttttccatctgatcggcagttggcggggtaaattgtgagattttgagttgataaacgtgatttttttcgtcataaaaatctgttacaaccaattccggcgtacctgattgactataccaacgacggaattgggttagatcaagtttattggcttgttccattgcaaggataaaatcttcacaggtcgccgccttgccatcatggtctgcaatataacgttgcatacctgcctgaaaacctttttctcctaataaagtatgaagcatacggatcacttctgcacctttttcatatactgtaactgtatagaaattattcatttcaatcactttttccggacgaattggatgtgacatcgggcttgcatcttctgcaaattgtactgtacgtaaaaattttacattattaatgcgattgattgctcgtgaaccggtatctgatgagaactcttgatcacgaaatacagtcagcccctctttcaaacttaattggaaccaatctcgacaagttactctatttcctgtccagttgtggaaatattcatgtgcaattacactttcaatcgctaaataatcttcatccgtggcagtttgcggattagccaaaacaaatttagaattaaagatatttagtcctttattctccatggctcccatattgaagaaatcaaccgctacaatcatataaatatctaaatcgtattctaaattgaaacgtgcttcatcccacttcatggactttttcaatgcactcattgcccaatgagcacggtcaaggttaccccgatcaacatataattccagtgcgacattacgaccgctctttgttacaaaattatcctgtaataagtcaaaatcacctgcaactaaagcgaataagtaacttggtttagggaaaggatcttgccattcaacccagtgacgaccatctttcatttcaccacaagcaatacggttaccgttcgataaaagataaggatatttagttttatccgctgtaatttttgtggtatagcgagcaagcacatcgggacgatccaacatataagtgatttgacggaacccttccgcttcacattgcgtacaaataccctcaccggattgataaagcccttgcaaagatgtatttgcactagggtttagatgagtaacaatttctaattcaaaggtattggcatttacgttggttaaatccaacacgaggctttcagcatcttgttgataagatttaaactcttcatcattgagtttgactgaaacaaattgaaaactatgaccatcaagacgtaactgtttgctttcaggattaagacgttgaaattgacttattgctgttacgatggtttgttgcggatcaagttgaaaatcaagataaatatcagtaacagtaaaatcgggggattgataattctttctatatttggcttttttttgcataatgacaacctaaatttattgagaaaaactgtgctaggatatgatttttcgctaggtatttcaagttataacaattaagggagcgtttcgctcccttttgaagttttgttacgctaattttaatggctcaattttccatattttttctgcatattctaaaatagtgcggtcagatgagaagaaactcatattcacaatattttgcaatgcactttcaacccaagcttcttgatttttatatttttcatccactgctttttgcatctcaacatagctacgaaaatctgcaaaagattgataataatcgtaagaacgcaatgaatttaacaaatcatgatagcgagtaggttctttgggtgagaaacgacctgcattaatctgatcaataacttcacgtaattgttcatccgactgataaatatcaaatggatgataaccattacgccgtaactcttctacttgctctacggtattaccaaaaatgaagatattatcttttccaacattttccaatatctccacatttgcaccatctaatgtccctagcgttaacgcaccatttaaagcaaatttcatattgcttgtaccggaggcttctgttccggcaagcgaaatttgttctgaaatatcagctgccggaataataatttgggcaagactgacactataatttggaataaacacaacttttaaacgaccttgtaagcgatcatcattattaatgatatttgccacatcattaattaggttgatagtttgttttgctgccgtataagctgaagctgctttaccggctaaaataaagacccgaggtgtccaatctttttctggattagcaatcatttcattgtaacgagcaacaatatgtaacacattaagaatttgacgtttgtactcatggatacgttttacttgaacatcaaatagagcgtttgaatttaattcaatacctaactcttgttttacataattcgctaaacgttgtttatttttacgtttaatctctggaattgcttttttcaattcaggatcttgaatatgtgctttaagcgtttctaattgagttaaatctttacgccattcagtgcctatatatttatcaaataatgtggataaatcaggattcgctaccgcaatccaacgacgaggggtgattccgttagtgacattggtgaaacgttcaggataaatgcgataaaaatctgcaaatgtagaacttaccattaaatccgaatgaattgctgccacaccatttactttatgcgatccaacaacagatagccaccccattctcactttacgtatattaccttcctcaatcaatgatatacgacgaataaagtcgttatcagtagtaacagaagtgcggacatattctaagaaataatcgttgatttcaaagataatctgtaaatgacgaggtaatatcttcgccatcatttctaccggccaagtttctagtgcttcagacattaatgtatgacaagtataagagaatatctgacagcacatatcccaagctttttgccaagtatatccttcttgatcaattaaaatatacatcaactctggaatagctaaagcaggatgagtgtcgtttaaatgaattgcaattttatccgctaaattatccaatgtattataaattcgcttatggcgtttaataatatcttgtagagaagctgaaactaaaaaatactcttggcgtaaacgtaattctctgcctgcagctgttgaatcatccggataaagtactcgagaaacattctcactagaagatttttcttcgatagcatggaaataatcaccacgattgaatgacactaaattaaaagtttcacctgcgtttgcactccataaacgtagtgtagctgcactgtcattgctatatcccggaatcatttgatcgtaagcaagtgcggtgatttcttctgcatttttccaaatacattttttcccttcaaaataaatatgccctccaaaacggatattaaagcgtttagacggacgaataaattcccaaggataacctttttctaaccacgcatcaggtttttcaacttgtttgccatcttcaatatattgctgaaacataccatattcataacgaataccatatcccataccgggtattgcaagcgttgcgatagagtccataaaacaagctgctagacgacctaatccaccattaccaagaccgggatcaacttctttctccaatacatcttctaaatcgacattaagttcagctaaagcatctttagctaagtgatatacgccttcagaaattaaggcattagataaagtacgccctatgagaaattccattgaaagataataaactcgccgagtttcttcttttcttgcttgacgggcagtggaaatccagccctctgttactaaatcacgtatggcgtataaagttgcatttagccaatcacgttgacttgcctcctccggggaacgaccaattaaaaaaattaatttatatacaatcgatttcttcaacgaatccttcgtattttccggacgattataagaaaaaggaaggggaagtgtatttaccattaggctcaaactcctgatttaataaaaaactaccgaattttattcatctgtataaaaaaaacaataaaattttataaaaaataatttgaatatttctactcaaattatttcgctaaaaaatttatttatgtaaaagaatatcatatagggattgatatccttttgcagatgtctgccaactgaaatcctgttccatagcattgactatcacactttcccattgacttggtttacgccacaaagtaaatgcactatcaataccataacataatcccccaacatcagcatcattaaatacaaatcctgttgcatgacgtgctttgatgttttcactgctactatcaatgacagtatcagccaaaccacctgttgaacgaactaacggtaaagttccatattttaatccgtataactgcgttaaaccacaaggctcaaaacgacttggaacaagaatgacatctcctccggcaatcattaaatgtgataatgcttcatcatatccaatttttactgcgatattttccggatactcttgtgcaagccaattaataccggcttctaaatgtgctgaaccggaacctaaaattgctaattgcccaccttgttgtacaattctctcagcactaccaattagtaaatctacacctttttgctctgttagacgtgtaaccattacaaataacagtgcattaggattttgtggtaaattaaaataagcttgtaattttattttattcttacgtttaccctgcattgattccaatttgtaatgatcttcaatatacggatcactatacggatgccaaattttttcatctacgccattcaaaataccaaccaatcgtccctgtgctttcaaagtttgcaacaacccttgtaaaccataagcaaattcaggtgttgtaatttctttggcataggttggactaactgcagtagaaatatcggaataatacagtccggcttttaaataagacatttcaccatataattccaatccatctacattaaacatccaccaaggcaacccaatttcagttagatgataaggtaaaaaacgtccttgataggctaaattatggatagtaaacaccgatttagcaggacgtcctttatgatgcaaataagcagctgttaagcctgcatgccaatcatgagcatgcacaatttcagcacgccaccaaaagtctaatcctgtagtcaactctgccccaacccaagccaataaagcaaaacgcttatagttgtccgtataatcgttataccacatatcatgatatggattaccttcacgggcatataaatgcggtgcatcgattaaataaacaccaataccattgtattcaccataacgtagtacaacatgtccagcaaaattattaaactcagcaacaaccacagtattggggataccacgagaaatagcaggataagccggtaaaacaagtctagcatcaataccaatttcattttgcgcaaaaggtaaagcccccattacatcagccaatccgcctgtttttaataatggatataattcggaacaaacatgtaatactttcattgttaattttaatcctcccatcaaggcggtaaaaataaaaaattctaccgcacttatttatatttacacctagtctaaatgaatttcagagacaactttttcgccatttaattttttcatcattgattcagttaccaaaataacttttccagtgctacttacacggaagcgtttgcgatcctcttcaatatttacaccaataactgtgttatctgggataactacttggcgatcaataatacaattacgtaaaatacaatttttaccgatagttacttgaggcaacaccactgaatattctactttagaatcagctttcactttcacttgatcaaataacacagaataactaatttctgcatcagtaatcacacaaccaccggaaataagcgaattatctaccggtttaatatcttgcttgttatagaagaattttgatggataagtttgggtcggattaccgcgaattggccagcgttggtcataaatatccaattgcggatgttcagatactaaatcaatatttgattgccaaaaactatctaacgttcccacatcacgccaataaatctccccatccgtattacgtcccatacaagatcggctaaacggatgtgcatataaaacttcttcctctaaagattttggcagaatatctttaccaaagtcatgagaggtatacggtgtatttacttcacgcatcaatacatcatatagataatctgcatcaaacacataaattcccattgaagctaaagaagtatccggtttatttggaatcgccggtggatcttttggcttctcaacaaatgcttttactttcaaattttcatccactgccatcacaccaaactctgatgcttgttcacgtggaacttcaatacagcctacagtacattttgcattgcttgaaacatgatctaagagcatttggctataatcttgtttataaatatgatcaccggctaaaattaaaatatattttggacggtaatgatcacgaataattgccatattttgataaaccgcatcagctgtgccacgataccaagtagaatcatcaatttgctgacgtgccggtaacatatcaataaattcaccacgttcttgcggtagaaatgaccaccctttttgtaaatggcgtaataaagaatgagcagcatattgtgtaacaaccccaatgcgatttaagccggaattaatacaatttgataaagcaaaatcaataatacgacggttgccaccaaaatataaagctggtttagcacgtttatctgttaattcgtgaagtcgtgagcctcgacctccggcgagaattaatactaaggtatctttaacaagtttatgtttacttaaatttttagtaatactgttactcatagcaactccttatcttttatttttatactcacgactaactcacatttacttgagttattcactttttctgcaacacaccaaaagccaaatccgtcatctccaactgcttgttttctaaatgtactacttttgaataacacaaaatctcccaattgccttgaggtaataagaatttttgtgaacttgtttttgcgttgataacgaacaggtatttactgtccagcaaaatctgcagagctttgctccctttattatgccactcatctaatgacatcttctcagcatcaatatttaaccaagatacattgctctcctgccaccaattatcccgttgtaaactcggaatttgtttacgcaatgcaataacttgcttaaccaaattaaagagatcttgttcaaaatattgccattttaaccatgttgtttcattatcttggcaataggcattgttattaccgtactgcgtattaccaaactcatcaccagccaatagcattggcgttccgtttgataataacaagctcagtaacaacgcactacgacttaaataacgagcttcttcaacaagagaatttccctctttatatccttccataccatggttataactataattctcactccgcccatctcgattatcttcaccatttgcccaattatgcttttggttataacttactaaatcatgtaatgtaaaaccatcatgtgcggtaataaaattgatagaattatgtggtaatttcccctgacaacgatatatatcactcgaacctgcgaaacgctctgcaaaaacaccgagttcaccacttttccataaccaaaaacgacacatatcatcacgaaatcggtcattccattcagcaaaatacgctgggaaattacctacttggtatccgcccatacctatatcccaaggttcggcgataaatttaactttttgcaaaattgagacctgctcaatttctttaaataataaggcgttagcattaaaatccggcgtttctcgtcctaaaactgaggctaaatcaaaacgaaaaccatcaacatgacattcttctacccaatagcataaacaatcaattatccattttcgtcctatttcagtggataaattaagtgtatttccacaacctgttagattaatgtagtttcccgcttcgtcctgccaataataagtccgatcatcaattcctcgttgactaaacgttggaaaatgcttttccgattcaacagaatggttgaacactacatctaaaatcacctcaattcccgctttatgtaatgcttttaccattgatttaaactctgttaagggtgttgtatcggcttgatttgaccaatatttggactcaacagcaaacatcgctaagggactataaccccaataattctgtagtcttttctcctgcaagtgcggttcatctaaatgataatttattggcaataattccaccgcacttacacctaattctttcaaataggcaataacattttgatgagctaaacctgcataagtccctcgaattgcttccggaatgtcctctcgcaactgagtaaaaccttttacatgcaattcataaatgatactttctgaccaaggtgtttggggtaaaatatctccttcccaatcaaaagatgacgattcaattaacgctttaggtgctaaatgtgcattatctctctcatcttcaagtaaaaaccaagctctattttctgcacaacttaaatcaggtttaccaacaacagcttttgcgtaaggatctaacattaatttatttggattagataaagaaccatccacgccatgaatacgaaaaccatattcggttccatattccaattcagctatccaaatatgccatatattttctgtacaatacattgaataacgggtttcttgaacagaatttttattaaaaatacaaagttcaaccgcacttgcctgtgaggaatagattgcaaaattaaatcctgcaataccttccatacaacattctgtacaacctaaaggatatggtttacctaaacttatcttactcataaaaattcaaattgtttttatacctttagctaacgttgttttctactgatgtcgattctgcaatcacctctgcatttggaaaaacagcactttcctcgttttttacttttttaactaccgctctttttgttaccgtctttttaggcttaacctctgttgcctcagagacagtatcagcgacagtttttttggttctcgtggttttaccctttgctatttttttctctgttttcaccgctgtatcttcaactttcgaggtttttctcatttttctgactttttttactttatgcagtttaagatacactgttgctagaggagggatatcaatactgatagattgtgctttattatgactttcaatatcttcagttacaattttgctcgtatttgtcgaatttgatcccatatactgttgtgcatcggagtttaaaatttccatatattcaccggcaatatttacaccaaaacggtaattttgacgtaaaacaggggtgaaattactgataacaataatacgttcatcttttttactacgacgctcaaaaacaaacacggaattttgataatcatcaacaacaagccattcaaaaccttgtggatccgtatctaactcaaagagcggtgcatttttttgataaatatgattaagatctctaacataatcctgtatagctttatgccagccaccaccatgaatttcatcaagaagataccaatccaaactttcctgataattccattctctgccttgagcaaattcattgcccataaagagtaattttttacccggataaccccacatataaccataatatgcacgtaaattagcaaatttttgccacgcatctccgggcattttaccgagtaatgaacatttaccatgtacaacttcatcatgtgaaagcggtaaaataaagttctcactatattgatacaccataccaaaggtcatttggttatggtgatgttgacgataaatcggatcttttttcatatacgacaatgtatcgttcatccaacccatattccatttaaaatgaaaacctaaaccaccttcatacggaggatgagtaacaccggcaaaagaggttgattcttccgcaattgatacaacaccaggaatttccgttcccaataaatgattagtttgtttcaaaaattcaatggcctccaaattttcacgaccaccatactgatttggtatccattgcccgtcttcacggctatagtcacgataaatcatagacgcaaccgcatctactcgaataccgtctaagccaaaccgctccatccaatacaacgcattcgaagccaagtaattttttacttcatgacgaccgtagttataaatcaaagtattccaatcttgatgataaccttctttgggatccgcatgttcatataaagccgtaccgtcaaaagcaactaaaccgtgcgtatcgcttgggaaatgacccggaacccagtctaaaatcacattgattccagccttatgagctttattcactaaacgtttaaaaccttcggctgtaccaaaacggctagtcggagaatataaaccaataggctgataaccccacgaaccgtcaaatggaaattcagagattggtaaaagctcaatatgcgtaaatcccatgtcttttacatagggaataagctcatcagcaatttgatcataatccagccaaaaattattttccaagttacgacgccaagaacccaaatgtacttcataaattgaaatcggctgatcagcttgattagcttttcggcgtttttcagtcattgatacaatttcaggcaatgccccaatttgtgatgctgtatcaggacgtaattgtgaactgaaggcataaggatcggcttttaagcgtaattgattatgacagtctaacagctcaaatttatacagttgccccaacgatactttgggtaaaaataattcccaaataccgctagattgatgaaaacgcattgggtgccggcgaccgtcccaatagttaaaatcgcctacgaccgaaacacgtttagcgtttggtgcccacagacgaaaatttacacctgctacgttgtcacattcggtaaaatgtgcacctaaaatttcataagggcgtttatgggagccttctgccagtagccaattatcaagttcattaatcatcggatgaaatgcgtaaggatcttctataacttgagcttcatttccccaataaacttctaattgatacgcaaaaaaactatgcgtattaggcacaacaccggcaaaaaaaccacgttcatctaccctcgataattcacaaagtacattttttgtttctttactgagaacaaatactttttcagcatccggtaataatacccttacttcaatcccatttgacgtttcatgcatacctaacacggaaaaaggatctgcatgttttccatcaaaaaaagtatcaatggtagattgtgatacaaatttattcataaaaaccctgcctatttatttcttgcctgattaattgttctaattaatgaaagtactgttttatcagtaaaaattttttctagcggttgtaataatttcttacgccagttaggatattccgttgaagtaccgggtaagttaaaagaaacctcttgattaagtaaattttccagttgtatacctattaattgcgtttgactttcagctaaatattgatgaatgacatgatttaaattatcgtgcattgccatatttaacgcatctccccaataatcaggcggtaagtattgatctcggtgcaaagtattaagcaacgcttgtttatctactactcgctgatcatattttgattttaaaacaccttctttcaacatacctaattgagcaaacagttctaaatcacgacagtgccaaaaactctgcaatgaaggaagatcatgagttccaactgtagcaaatgcttgcaaaggaaaacgatctgctttcggatattcgttgtgttgttgctcaaaatacagaacaaaataagagaacactttaaattcatccaatttaaaccgcacttcattaggtacagtacctaaatcctcaccgacaattaaacattgattacgctgactttcaattgctagaattgccatcaactctgcaaaaggataatgtacataaagtccatcacaggcactttttccttccggtattaaccacaaacgaaacaatcccataatatgatcaatacgtaacacaccaaaatgctgcatattggctcgcaacatatcaataaaaggctgaaagccacgagcttttaaaattgttggattataaggcggaatattccaattttgtcctaccggacctaaaggatccggcggagcaccaactgaagcgttcacacaataaagtgtttgatcggaccaaacatccgcacttcctctcgaactgcttacagccaagtctccataaattcccaacgatagacctttttccaagcacaagttttttacttcagttaattggatagtagccaaccactgcacccaagtgtaaaaatccacttgtgttttatatttacgtaacaaatttttgcgttctttatcagttaaaatttgccattctttacgccaacctaaccaaccaattttattttcatcttctggcatattttgatgttcaatactatctaatacgtcaaataaagcctgagataataaagcatcaccttgtgccttcacaaactcagcaaattggcgacgacgctcaataattttacttgctctgctacgcttaaaataagcgaataactcttctaatgcagaacgttttaatgacattactgcctgataatctacgatatcagattggcacaactcagtcagtttagcttgagtattctcttgtttaaaccaattttggactttttgacataaattaaattcaggtaatttatctactgccaaatataaaaaattcaaccaacgtcttgaagaagaactgtaaggacttgcccattcaggaatagccggataaagttgatgtaacggattaattccaataaagtcagctcccagcaccgcacttttctcaattaaatatgcaagatcggcaaaatcgccaatcccccaattgcgtgcggaaaccaaactataaagctgaacattaattccccatgcttttttacgttgaaatactgtcggttgataagattgttgaggcgaaactaaaatgcgaacgacatagttatttccatttatttcaagaagcaacgaataataaccataagctaaaggagataatgttagttttttccgctctttaagaagttggctccgagacaggaagttcccattatcatcatacaaagaatattgaatagaaatgccggaagataaattaaatgcggttaagtcataaattataggttcattttcactgacgactattacatcatcaaattttttatcttctgagctaacttccgtttgactcagtaattgaatgaaataatgcagactttccagttttgcgtaaatcaaattaccatcaatatcataatgagatatggcaatccctattttttctgcatcttgttgtaattgattagaaatgcccatcttactctcaaaaagcttaaaaagaattaaatcaatttcattctatctaatcttaactgacaaaagcaaacgcattactttaaattgtgatccagttcaaatagaaattttaagttttttcatcaatcacaaattcaaaccaatcaatcacatctttttcatgaataccctgctcaatcatcacaccagcacgtttcatcgcttgagaatgaccaacgatgagaggatgccaatcaaagagcggtttattttcataaagtaaacgataagcacaagtactgggcaaccaactgaaatgtggcaaatttgctttagttaattttgtacaatctttctctaagcgaaaacgtttctcataatgaccgcactttcccgtttctaaattcaatagattgcaagcaatacgagtaaaatacagcttttgtcgttttcctcgcccttcaataaacttacggtaacagcacttgccacaaccatcacaaagtgcttcccattcttcatcgttcatttcaagcaaagatttatatttccagaattcaggggataaagtcatttcgaaaaaaaccgatactatcatcttaaaaaaataatccggttaaatattattcaaccggactcgtagaatattacccaattcagggagtgcggaatttaaccgcacttttattactgtgtcaatattgcttcaaatctaaattgagatggcaaaattttatgggctaaagcctctatattttgttgagttacttgctgtaataactgttgctcagcaaacataagcaaaggaccatcactcaaagaataactttgttccaattgagataaaatggctaacaatgattccttcgcctgttttaactgagattgtttttcattcacttttttagccaacaattcaggctcaatgccttgtttaagtatttgatctaatacatgatgagtcatctgcgttaattcctgtacacgcataggatcacaactaaactctattttcccctcaatttgaggtgaaaaatgttcttgttcaaaccacgcatgcactgcatagatacccgatgcctgttctcttaaactcaaccgtaatttctcttgtatgatatccgctaaaatatccagtaaatatttgttttccacttgccattgatgatcagctgcgaaatacatttcaacttctgctcttggctcatgcaagcctttaacaactaaacgctgctcgggtacatgtgcctttatcggctgtaatactctattttgtgttttaaccggtacattggctaaatatttttcagccaaattttgtaccgcactttcgctaatatcaccaacaataaaataagtgaaatctgttttatccgtaatatattgctgataaattgcggagagtttatctgccgttaaatgcagattactgaaacgatttgcaccatatagcgtttcttgttgtggaaaacgcaattgctctactttctgcataaacgtcttttccggacttttttcattcacttcatcctgtaaagtttggcgatattcggctaaaactttctctgaaacagggctggtttgtagttttaacctaaataattgtagaatatccgctaaactttctgttttacctgccgccgtaaaaccctgatcagcctcatcaataaccgtcgtaaaagctatcggagcgtgactgaaatactgatcaatatcagcctgaggtacaatgccaattccggtatcatcgaccacagaaatcgccgctcttaacgcatgataatgtgatcttggcacagaacgtaatcctcctgctgtcaaggctttaaaataaacttgttgcggacttttatcactatacatataaatcaatttactgccgttacttaacaaatattcagtaattttttgtccacgccatactttttgcttagtggcattgcccgcaactaaatctaaatgcggaagctgaactaccctattatcttgttgttgccaagaagattgcgattgctgtaaagcctgttgccatttttgtgccaaccattgactatcaaacgataatttgtgcggttttggctgagtaatcagcaccaacttggactttaactgcaacatttgttgaaaagtgcggttaatatctgccaaagtcagttgattgaacaattgatgatttaattcatattgatcttgcggagagagtagcacttgatcatttgccatggtaacaactaattcatcagcaattttgatactactcacttccaaatgtcgttgtttagtatttattttacgcaaacgctgaagttcatcatccaattccgtctgcgtaaacccgttttgagcaatttccgcaataaagttaaagagttgctctgtcgctttttgataatcctcattctcaagttgtaaagaaaatgtggattgtaacgtttgcttacctaaataatcatgataaaaattagcagattttacgaccgcacttgaagactgctgtaaatatgtttcccattgttgcaaacgtaaattaagcaaacgtaccacaatttgttgccataaattctctcggtattgtgctaccgtattgatattttctgctggtttaaaaaaactcaagtccaatcccggttcacgcatttctttctcagacacggtcgctaaacgccatttaggcggtaaaggaatatcaaaatcaatctcgggtaaaggttggtgttgtagcggatggctactccctaatttctgttgaattaaagacttaatttttactggattcacatcgcctaccacaataagactgacattatccggacgataccattttcgataaaaatcttttacacgctgtgccgaaacatgtttaatgacgttgacatcaccaatcggatctcgttctacataacgtgaccccgccatttctatttggctttttttatcccctaaacgcaacatagggcttaagcgtgaacgccattcttccaacacaattccacgttccgcctctaaatccgctggtaaaatggtaagatggtttagccattgatcaataacattgaatgccaagctaagagattgcggatcatttttagcgatatttaatgtataaaccgtattttcaaaatcggtaaacgcattaatatcacgtgcaaacttcattcctaatttctcaagtgcattaataatttgattttgcggatattgttgcgagccattaaatgccatatgttcaacaatatgggcaacccctttttgatcatcatcttcgtgcatcgaccctgcattaactaccaaacgcatatacacacgattttgcggaaaatgattaggtaaaatgacataacgcaagccattttccagttgtccttggtgggcttgcgaatgaaaaggtaacgtatctttttcatgaaataaggattggcaagcaccaatccccaaaagagcggttaaaattagcaatattttttttaacattagaattcataccctaattcaagccaaaattcacgacctgctgcgtagaaaccattatcctcgttagaacttaacccctttctcgtttgattaaggacattcaatatatcaaatttcacaatcgcagaatgtttaccaaagattttaggttgccaacgaaggctggtatcccattgtgtatgagtgccgtaattgtaactgcgataaatcggtaactgactacttctactacctgtatccaattgtttaaacccttttataggtgcttttacataaattcggttggtccattccaaattataatttggcatagacatatccacgccaatccgagccatccattcttcacgattgttattaactttagaccgcatttctaattcggtcatttgttttccgtctaaaatcacaatggaattcgggtcatatcctacatctatatcaatacctttggtatttaaccaatcaaaccctagcgaagctcgccattctgtctgccaaaatttccaactgtctttattttgaatttgcaacgtatatacattattgctgtaatctttgcctcgtgcaaaatgacgcacttttttaccattttgaccatcttcttttagtatgatgcggtttttattttgacgatgaatatatcgggcatcaaggataacattcccgagttcttgattaatactgaaactcaattcatcactaaacggcgttttcatggaagcaacggactgataacgtgtggttcctttagtgccatcaatatcatctaatttgaaaattccctcacttaatttcatggaagcaaaagagcggccataataacggtttgctccgaggcttaatttggtttgttcaaagggttgatagcgggcgacaaaacgaggggcaatattggtatttttcaggaaagtatcacgctctaaacgtaatcccggacgaacttcccatttaccccccagcttgattaaatcttcgacataaagggcgatattgtgataatcggtttttactgttcctttggaaacggaattgctactccgaggacactccatattatcctgcatgaaaatttcagatttagcattttgatctcgttggaaacgataatgcgtaaattgccagataccccctaaggaaatggaatgttcagtacgtccccaagtcaacggatccatggcaaattcactggaaaaatgcacattgcgttgcgttaaagcactatctcccattcctccacgttcataattaatcggatcatagttttcatcaaatgccaatatttgcttcaaataattagaggcggatttacgcttatctgcaaattgatcatacgccaatgtattagttaacacaccgctctttaacgaacgaatccaagctaaagtagcaccataggcttgatgataatcttgcacattgctatcaacattctctgcaaagaatttagtttccacataattagaataacgcaaactcaattcaaagcgattatcctcattagcaagccagttaaaattcaacaacgcattatcggaacggcgtttatgtctgcgattatccgaactcaacttgtcatcttttcccagcactaaacgacgttgctgaatatctgaagtacggcgactaaatcctgctaccataccgatattttcccctaaagaatgttgtgcagaaaggctgaagaaatctttgctatatttaggttgaaaatccgcactactaccgttaggcgaggcttgtttaaatctttctcgatctttttcctcaagatgaaatttcgcccaattagaatgactggtacgataacgcaattgcacaccatcggtaccatcgtattgcttggttttggcgactacggcaccgccggcaaaaccgcctaaactggcggaaatatcgctgtcgtaaacggttacggaagacaataaattcgcatcaaagaaataggcttgtgcatgacttgccataggcaaagtttgcatcgctccctcaaaaatttcagagtcaaagcctaaatcattattgatattgacattatctacaaaataactggtttgattggcttccgcaccattaatcgaaatgtcagcaggtttaatttcacctcgttgaaaactgttttcatcactacgttcaaaacgcacatgagaattggttttcaaaaaatcagaaatattgccgttggaattaggggaagatttaatatctttggcggttactttttggctggaagataatcctgcgttttgctctgcataaacaacaacctccggtaattgattagctcgttcaactttatttttacttgtttctgcttgagcggaaaacgctaaacagacgctgacagctaataaggttttttgggtttttaaatcataaactgacataaattttccttaattagatataaatgataacaattcttataaattttatcatctaaattttttaatgtaaaaatgttcatcgcttgcagaaaaaaaataatccgaccataggtatgatcggattatgtgagaggcattaaaatcattaaatatactcagtaatacaaccgcacttttggcgaaaaggaactgatattaaaacccttctttcagactgacagttagattaaaaactaagttacccgcattactgtctttgctatcggcacaataatacccttcccgttcaaattgatacgcttgttcagctttggcactagcaaggctttgttcaactactccacgcttaatgattaaggaatttggatttaacacttcattaatgtcttccactgctcccggattcgctacggtaaacaatttgtcatacaaacgaaattctgccgataaattatccgttgctgacacccattgaataacaccttttactttgcgtccctcaggatttttacctaatgtttcgggatcataagtacaatatactgtggttacacaaccttccgcatctttttcaacacgttccgctttaatcacataagcattacgcaaccgcacttctttacccaacaccagacgcttatattgtttattcgcttcttcacggaaatcagcctgatcgatataaatttctttggtaaaaggaagttccctcgttcccaattcttcacgatttgggtgattaggtgcggtaagtatttctttcccatcaaaattttcaatcacaatttttagcgggtttaatactgccattgcacgaggtgcgtttgtgtttaaatcatcacgaatacagctttctaatgcactgtattccaccacgttatcctgtttagttacccctatacgacgacaaaactcacgcaatgatgcaggggtataacctcgacgacgtaaaccggaaatagtaggcatacgtggatcattccaaccgtcaacaatcccatcgttaaccaatttcagtagcttacgtttagatgtcaacgtatattctaaattcaaacgtgaaaattcatattgatgcggtaatggacgatcaatcgaaatattatccaatacccaatcatataaacggcggttatcttgaaattctagcgtacataatgaatgagtaattctttcaatggcatcggaaatacaatgagtaaaatcgtacattggataaatgcaccatctatcgcctgtttgatgatgacttgcaaatttgatgcgatataacacaggatcacgcataaccataaaaggagatgccatatcaattttcgctcttaaacttgccgcaccttctgcaaactcaccttttttcattttttcaaataacgccaagttttcttctatgctacgatcacgataaggactgtttttacctgctgatgtaagtgttcctctatactcacgaatttgctcgggtgaaagttcatcaacataagccaacccttttttaattaattcaattgcataactatacagttgatcgaaatagtcggaagcatagcgaggctccccctcccattcaaaacctaaccattttacatcttgcttaatactgtcaacgtattccacatcttcttttaccggattggtatcgtcaaaacgtaaattacatttcccctgataatcttgtgcaataccgaaatttaagcagatcgatttcgcatgaccgatatgtaaatagccgttcggctcagggggaaaacgagtataaacattatgatgttttccgctagctaaatcttcatcaataatttggcgaataaaatttgttggtttatgttccgtattttccatttcaactgttatttcgctcattttttgtcctcaatgcaatttgataattaaaaatctgcgtattttacagtgttttgcacagaatacaaagcatagcggattttatctcacttggcatatctgtacattaccttttgtaaactttcaggtaaaatagcataacttctaatacaggtatttttataccgcacttatttttcatgaaaaggaacgtttatgtctgatttgaccctacacagccgacatacctatttagatcaagtcaaacacattgtggcaatcggtgggggtcatgggttaggacgtgtcatgtctgcattgagctttatgaatgagcgtcttaccggtattgttactacaacagataatggcggctcaacagggcggattcgacaaactcagggcggcattgcttggggtgatttacgtaattgccttaatcagatcattacagaacctagtacagcatctgctttatttgaatatcgtttttccggtcaaggtgaattagcggggcataatttaggtaatttaatgctgaaagcactggaaaatatgaatatccgtccaacagatgcggttaatttaattcgagatcttctcaaagtgcggtcttttattgtgccaatgtctgaaagccctgtacaccttgccgcctccttgtctcccggtaaaagtatcgttggagaagtaagtattgatcaattaaccgaaatccctacttctatttttttagttccattagtacaggcaaccactgaagcaattcaagccttaagacaagcggaagtcattttattcggtccgggtagcttcttaaccagcattatgccgccattattactaccagaaattattgaggtgctgaaaaatagtcaagctaagaaaatctttattgataatttaggtgtagaacacggtccagccgccaaattatctttaatcgatcgcattcaatggattaatcaaactattggttgtgatattattgatggtgcgatcgttcaaagcaagccgcaacagaatcatcacgcctcctcaataaaaatcatggctcgccaacttaaagccgatgatataggctaccgccacgaccgcactttactttgtaatgcgattgacgaattattgatagaattagctcatcatttttcacctaagcaagtttgactaatttagctggaattccttgtctaacagcggagccacatacccaatcaacccaaggcgaggcaatctctttggtactatctaacaaaccaagatcattaatattaactccggaaccaatctgagcatttccttcaattaatttcccattaattgtataacctgtagcccccagttgtttatgtccataaccatgttcaatcgcaatcgtccctttaatgacaccgttcatcacaaccagctgcacaacagcttttcctcccggggtatttagctccacaaggtcaccatgctgtaatccatattccgtggcatcctgttgattaattgccacaataccattaggtttaatactatgtaatcttagtaaaggtgctgtaatactactcattaaatttgatttaaaggaaattaatttaaatggccattgtattttagggtaatggctttcaactgtgctattatcggcaaactgatcttcaaaatacgttggacagccgtgataatttttaccggtttgagcatgtttggcttttgctacattttcattccaaatttgcaaacagtttttccagcgagcctgcatattatcttcctgccatgcactgctatgaggagcaaaacgtccgcctttacagtaaattgtagccactttcttaatttcttcaggttttaacacttgttgtaaacttggcatcaaacgttgtacacccgttagcaataaatcttcttgagttgcatcttgtaccggctgttttccatcataagctatattggcagctgctcgtaaaaagaagtcttcactacgatttaaaggataggaatgattttgtttatctaagatagcattatcaccaaatccaggtaattgcatcatcttagcaatttcgataacaaaactttccatacaaatagtatcgccttgagatgttttctcattaggcgatgctatcacaggccagcgagcagtactggtttttgttggaacaccagcccaaggggtactaaatccccaactctcaaaattatgggtatccggcacaatataatcggcaagggcggtagtttcattcataaaagcatcaatagaaataaagagcggtaagattttcggatcttttaatttctgttgcgtaatatggtgaatacctgtcataccataaattggattccccatatgattaatccaagctttaagtgagtatggatagccttgtaaggcagaagtaatcatttctgacatttgtccgccaacaaaaggataccaagcggctttcgccggatatggagaaataccttgtgctactttttgtttaaattcactggatttttcatagtcttttttactacgagctaaatttgttccttttggtttcatcatattggggaaatttgcaagattgtaacgaggtccggcagcaaaatctttaaatttaccgccactcatactcatccccccttttttattcatatttcctatcatggcattaagtaacaatatcgcccatgctgtatagaaaccattgctatgcatagttccaccgtgggtaataactgccgcacgaggtccatgagaagtaaactttttagcaagttgaataatagtatcaacaggtacaccacactgctcagaatattcctcgatggagtatgaaaaacaagattctttgaataattgtaaagctgatttagctaaaacctgtgagccgtctttaaggcttatcctgtcttccacaaaaagcaccgcactttggcaatctttggcagctataaatttgcctgtttgtcgatctttcaccaaaatatcactatcgctcaatttttcaggttcgggtaaatcctctatatgaaaatttctaatggcttgcccatactgcttatgatttggatcggcgataaataaatgtgttgcattacaaaaacttacgccattagcttgttgcatcgcaatttcacttggtatagacaaataatcttcgttataacgttcattttcaataatccaacgtaacatggctagtgctaaagaaagatctttacccggaataattggtacccagcgatttttatcttgtgatgcagttgaggtaagctctaaacgaggtgctatcacgacatattcaaaattatcctctgtacgcttcttagcaagctgacgagattgacgtttaaatggatttccggattgtgcaggagaagttcccataaacaaaataaattcaacatgatcccaatcaggtttagcatgagaattattagcaaagtcattcataaatgcaccggatccggcacgataggataaaccacaaaaagagccatgagaggcgaagttaatggtaccaaaactgttgcttgcaaaacgtttcagaagaggttgtcttccttcaggacctgcgaaggttaccatcagttgatttacttttgcaccaaaatcagggtgttgtgcattcactggcgtttgcaaatcacgaatcgcttttaatccatctacatgcccctctccaaatagatctccgccattcacaacttcatcaattaattgctcaaaactgatcgttttccatttaccttctccccttttacctactcgcttaagaggttgtgtaatacgataagggctatttatcccatctaaaaatgcagctccacgggcacaagcagtagaacgttgctgtaagccattttcaccagaaacgcttaactctgcttgtttaattgattgattgtaatcaaggtaatgatctgatgagagcgggtgataaggattaccgttaatacgcaatactttatttttttctaaatctattcgagcccgtaaaccacatagagtccagcaacccatacattgggtattacacactacttgttggctattagttaataaattgccctctttgacttgatattcaggtaataaagaatttccatttatattgtcttgtgttttttgtcctgaagaaccttcaattacgccctttgcaatttcttttactttgggagaataacctgcaacaaaagcagtagcggcagttgtagccaaagctccttttatcaaattacgtctttgtttattcatgatcttttctccccaaatttgattgcaatagtgtatgagatagcagttgccataaaataatacctactaatgaccacaagctaaagacagctatcattccaattagcccatctacgttccaactcaattgatatggatttaccaaagcgttatattttgcgatttgctgtacttcaattaataaaatccaacgggtaagccaagtgatacaaagtgcggttaatattcgtaataaccttaggaaagttgaatgaggcaataacagcaatatgaacaaaacgaagatcccaatgagtaataacatcggtgaatagctaatttgccataatttcattaaatgaatagctgtttgctcagaaaataaataaatccccaaaatagaaactattaatcctaataaactggcgatagtaaagtatctgagagcataaacttgaggtataaaataatgacaaaataataagctgacgggtaaaacactaaatacaagcaaaggtaaaagccaagtgtgattccataaaggacgagcctgtacagtgaagacctccatcgtggtatacattaaaatcaatattgtcataattaaagaaagccaaacaaaaaagactttaattaaatcagtattgaatttcccccaataaagccagtgaaaatacttaggaatagattgcattggaactgaggtacgtaatgaacataaaaaatatcctgccacggataaaacaaagaaaggtaaaaaccatgctccccaatacatccaagaccatatcgttgggttcaaataaaaattcataatacgacccggttgatgtaaatccgcagttaaggcaataggtgcaacaattgcacaactgaacgctaagctaagagcaagcaattcaaggcgtgaatttttaataaaatgaaagaagaacgcagtcaaaacagatgaacaggctaatccaataaagaaaaaatagcttaccgcccaaggtagccaagcaatagcttgtggttctactaagatctcacgaataatcattctgctttctccttatcttgccataacattggttgaccgttaacttcattcacaaaagcatcatctaaacctagataaaatacatgtggaatggtaccgtcatccggttttaaaaccttcaaatcatctttaaattcatctaccattttactaattgtactggttggatcccgtaaatccccaataatacgagctcctcccacacaactctctacacaggcaggtaataatcctgcttctaaacgatgagtacaaaaagtgcatttatctgcagttttagtttctgaattgataaaacgagcatcataaggacaagcttgtacacaataagcacaaccaatacagcgtttgttatcaatcacaacaataccgtctttacgctgataagttgcttgtacagggcaaaccggcacacaaggagggttatcacaatggttgcataatcgaggaagtagaacattattggtaatattctgttcattggtgacttcatattgacgtacggtagtgcgaaactcgccaagcggtgtttgattttccaccgaacaactcaccgtacaagattggcaaccgatacaacggcgtaaatcaactaacatggcatagcgatgagcttcattaccctcttttctttccggctgaaaacttgtattcgcttgagaaaaagggataaaagcctgcccaatagttagtactgataagtttttcaaaaaacgtcttttgcttatgtacataatcacccctacctttaataaagattgagcattcaagttgatcaattcaggttgtctgaatatcaatgcttaatcttcccactcacaaataaaatatttaataaaattgagttgttacctcttttagcgtattgttaaaaaatctccatgaaaaaaccattgtggttttccacataaaaatatgaggatattgatcttcatcaataaaaggaaataaagtgagaaagtgcggtcagtttttaaaaaattttatgttaataatggctttattgccccagttagcttttgcacaatcttggaaaatcggtattttggcacagcgaggaattgctgaagcacatgagcgttggcaaccttggattgattggctaaatcaacaatttgatgaacataaccaattttcattagttactctcgatcttaatgatctagagacagaacaagcacaaggagttgactttattttaagtaaccaatcccaatttttttatttaaataataaggaagttcgttggttggtaacattaaaatcgctaagacaaaaacaacatgacagcacaggaagagttggtagtgctatttttgttcgtagtgaaagtaatttttatcaattgaaagatttgaagaataaacgtataagtgcggtaggaaataaagcatttggcggatttttattaggttataacgaattatataaccaaggcttgatggaaaataaagatttcaagccggtttttacgggatttccggtagacaatacactattttttttaaaagagaaacaggtagatgcggcaattgttcccgtttgtatttttgagcaattggtaaaagagggaaaaataaaggctgaaaatttccgtctattggcagaaaaacctaaccacattggttgtctggcgagtacagtcttactacccaattggtcattagctgcaatgccacaagtacccggtgacttggcatcaaaattaataaccctattgcttaatcaagcgtctgataatcttccgcaatggacacctccatattcaacaaatcaagcggataatatactgcatcagctatataaacacccgaaacaaaatttgtggcaagcaataaaatattggttctcacaatatcaattttggattactggtattattctgcttttattcgttaattatatttggataaattggcagatacatagaaaaagtaaagccttacaacaagcgtatcaacaacatcaaaaatatgaacaacagttgatacaggctgatagactttctattcttggagaaatgagtgcaggtattgctcatgaaattaatcaacctcttactgctattagaatgtatgtggaaggtatgaaatatcaagcagaagaacaaagaactcaaatcgtattggataaaatattacaacaagtagatagaagtgcggagattattcataacttaatgaattgggtaaaaggaaaaagtagcgaagatattgagttaatcaatctcaaacatttactaaaaaaagtgactcaattcatttctctacaacattataataaatttcaaattaatctagtttgtgcaacagatatttatttggaaataaaaaccacaattttagaacaaattctctgtaactgtttattaaatgccttacaagcaaaagcatcaatgatagatattatagtagagaaagagcaaaaagaactaaaaataagaattttggataacggaacaggttttcaacaaatagagttggattttccttttgttcctttccgcacaagtaaaaaacaaggattgggcttgggattagtattgtgtcaacgtctaatccaagcgatgaacggtaatataaaactatcaaatagacaggatcaatctggggcagaagtgaccttaatcttacaaataaaaggaaaatagtatgaatattcatctacttgatgatgacttaacaatacttgatgccgctagttttttattggagcaagcaggttatcaagttaaaacttggtctaatagtcagcaatttgtacaacaagctaatatttttgagcctggaattttgttattggatatgaaaatgcctcatttagatggaaaagctgttcatcaatttttacagcaacaaaatagcccttttgctgtaattattatgacaggtcatggcgatatccaaatggcagtacaagaactcaaattaggtgcagtagattttttacaaaaacctatgcaatttagccaattacaatcagccattaaactggcgagaaaaaaaacaatggataattatgaacaatatcaaatcaaacaatgttataagcaacttagcactaaagaattagaagttttatctttattattaaaaggttatattaatcgacaaattgcagaaactctaaatatatccgtcagaacagttgaagtacatcgttcacatattatggaaaaaatgcaagcacaaacagtggcggaattaatctacaagatcactcttattaaaaaggacgaataatattcgccctaatgatgtggtctactcaatttataccttcatttgcagtctaattgcatcagcaaccaattagcttttgcacctaacgcttttaactgattttattcaatactttcacattatcaaaccctttctctcgaagatatagagcctgtaacttactcatcacccctcgttcacaataaagaacataatttttactttgatctaattcagcgaaatgtgaagataatttataaaaaggcattaaaataatattctgtcctgagatttccagcggtttatcatcgacttcctccggactgcgaatatctaaaatcacgtcattagccgataaaaccgttatttcatcaacttcaaatacttctttttttgtttgttcggcaatttgacgaatatctaaatattgtgcatttttcaccgcactttccagcacggaaaaatcaaaataactttcttcctgttcgattttttcttttacagcttttattgtcggacttttagaaatgacaccgcaaaattcaggcatagatttagcaatgtcctctgtaccaatttcttttgccttagcaataatttgttctttgtcatgcgtaattaacgggcgtaaaactaaactttcagccacctcatcaattaagcgtaaattagttaatgtttgactcgacacttgtcccagtgcttcccccgttacaatcgcttgaatgccgaaacgttgtgcaactttacttgccgcacgcaccatcatacgttttaacacaacacccatttgtccgttatctactttttctaaaatttccgcaacaacctgttcaaaattaatagcaacaaatcgcactttatgcgaaccgctaaaacgcttccaaatatgatacgccatttgtttcacgccaatttcatgagttgctccgcctaaattgaaaaagcaataatgtactctcgagccacgacgaattaacatgtagctggatacaccggaatcaaatccaccggaaataagcgataaaacatcttcttgtgtaccgataggataaccaccaatcccctgatgacgagctttaatcaacatcattttgtcattttcaatatcaattctgacggtaacatccggtttgctcaactgcacttttgcacttgcaacggcttgatttaaacctccgccaatataacgttcagcatccaatgaactaaaatcatgttttcctttgcgttttactcgtacacaaaatgttttattctcaatctgagttgctacatcactcaaagtttgctcaaaaatatcgtgcaatgtgacaaaaggtttttcttccacttctaagaaatgatgtattccgggaatacgtccgagtaattcaaccaatagtgtccggttttctatattcttcgaccgcacttcgatgtaatcccaatgtttaactactgcaacagtatcatcatatttatttaatacattgcgaatattaccggttagaattttcacgaaacgtttacgtacgctttcgcttttaatcataatttcaggaaaaagtttaataataaatttcataatgagtttacatagctttaatttgatgattttcagcacacgtttcgcatactgaattgccttaagtttcgtgacatattagcattcatgccaaatgatataaattaatttttcatttgctatataattttattcataaaatacagtacaatggacaccctgatttaagatgaagcaaggatgattaatatggcacagacacttgacaaaaatgcaactgatgaactcaactttgaaacaaccctcgctcaacttgagtctgttgttcatgtactggaaaatggcgatcttgctcttgaagacgcattgaaagagtttgagcggggtattcagttggctcaagccggtcaacagcgtttacaacaagctgaacaacgcattcaaattttattgcaaaaaagtgaaaatgcagaattaagcgattatcaaccaagtgaataaaatagttagtttctaatgtatcaatttgctcaagatctccaagaatccaaacaacgaattaatttttttttagaaaaacaattcgagtgcattgatagttctccatctcctttagctgaggcgatgaaatatggattattgttaggtggaaaacgtattcgcccctttttagtttatgcaacaggaaaaatgctcggagcgaatttaattcaattagattatgcagcagcggctattgaagctattcatgcttactcactcattcatgatgatcttccggctatggataatgattcactccgtcgtggacacccaacttgccatattgcctttgatcatgctaccgctattcttgccggcgatgctttacaaccttttgcttttgagctgttaactcaaacacccgatttgtctgccgaacaaaaattagctttagttcaaactttagccaatgcttccggtgttaaaggtatgtgtttagggcaaagtttagatttaatctcagagaatcaacaaattaatttatccgcacttgaaaagatacatcgcaataaaacaggtgccttgttgtcagctgcagtgaagatggggtttatttgttctccgcactttgcaaatataaaattagaagaacaattaatgcactactcctctgctgtgggtttagcttttcaggtacaagatgatattttagatattgaaggtgaaagtatagtgattggaaaaactgccggatctgatctccttgccgataaaagtacttatccaaaacttataggtttagatggtgcaaaacagaaggcacaagaactttatcatcaagcactacaagaattggatgctttgccttttgacacttcagcattacatgcactcgctgagtttgtcgtaaatcgacaaagctaagttcggttaaaataaaaatggaataacgaataatgaataaatatccacttctctctctaattaattcacctgatgatctgcgattattaagtaaagacaaattaccgcaactttgtcaagagttacgtagttatttattggaaagtgtaagccaaagcagtgggcatttagcctcaggtcttggcacggttgaattaactgtagctttacattatgtattcaaaacacctttcgatcagttactttgggatgtagggcatcaagcctatccacataaaatccttaccggccgtcgagataaaatgtcaaccattcgtcaaaaaggcggattacatccatttccttggcgtgaagaaagtgaatttgatgtgttaagtgttggacattcatccacatctatcagtgcaggtctcggcattgcgattggcgcacagaaagaaaatctcggacgtaaaacaatttgtgtaatcggtgatggtgcaattactgcaggtatggcatttgaagcattaaatcatgcaggctccgtacatacggatatgttagttattttaaatgataatgaaatgtcaatttcagaaaatgtgggggcattaaataatcatctggctcgcttattaagcggttcaatttattctactttgcgtgaaagcggtaaaaaaattctttcaggacttccgccgattaaagagtttgtcaaaaaaaccgaagaacatgtcaaaggtttcgtttccccagagggaaccctgtttgaacaactcggttttaattatattggacctattgatgggcataatatccatgaactcatatcgactttaaaaaacatgcaatcattgagcggtccgcaattcttacatatcaaaacgaaaaaagggaaaggctatgctccggcagaaaaagatcctattggctttcatggagtacctaaatttgatcataaattaggggaattacctaaatcctcaacgacaccaacttactcacagatttttggcagttggttatgtgaaattgcagcacaagatgaaaaactgatcggtattacgccagctatgcgtgaaggctccggcatggttgagttttcgcaacaatttccacagcaatattttgatgtggcaatcgcagaacaacatgcggtaacttttgccgccggtttggcaattgcaggctacaaacctgttgtagccatttattcaacgttcttacaacgagcctatgatcaacttattcacgatgttgccattcaaaacctacccgtgctatttgctattgatcgtgccggcatagtaggtgcagatggacagactcatcaaggtgcattcgatttaagttttatgcgttgtattcctaacttggtgattatgacaccaagcaatgaaaatgaatgtcgtcaaatgctctataccggttataaatgtggaaaacctgctgctgtacgttatccacgaggcaatgcaatcggtgttaagttagaaccgcttgcagaactaccattgggtaaatcaaagctgattagacaaggtaaaaatattgctattttaaactttggtactttattgtcagaagcaacaaaagtcgctgaagatcttgatgcaaccgttgttgatatgcgttttgttaaacctttggatactcaacgtattcaagaaattgcacaaactcattctttgattgttaccttagaggagaatgcaattcagggtggagccggaagtgcggtagctgaaactttatatcagcagcaacaaaaagtttcattattgcaattggggctaccggataactttatccctcaaggtacacaaaaagaaatgctagctgagttaaaattaaatgctgaaggaatttttgaacaaataaaacaatttttgcaaaaaatttaatatttttatgaactattttttatgttggtagtcttatagatcgctagtgcactgcaattgcagttgtctttttaatgttaaagtttcttatattaagacctccccgctattcaatctttgaatagcggttttttcttttttaacactcaacagctataaaagagcggtgatttttacaagtaatctgtaattggacttgactgataaccttaatgtggtaaaacaacgctttcaagtattttggaaggaagatgaatatgtatgaaggactgcttattgtattggttccaatgttcattggatatttaatcaaaacaaaaaatgccgcacttttaacacgcataaatcatattatgatgatattgttatatatgatcttattcgtgatgggattttctctaggtcaattggatgatttagcgaaacaactaccgataattggtatctccgcctttacttttgcgttaactattcaaagttgcaatattatggggctgttaatttacgataaattaaatcccagtccattaccccatctcgccaaagaaatgccttctcgttggaaattacttcttgacagtgcgaaactttgtgcaatggtgttattaggctttgtgatcggtttatcggtaaaaagttggtttatgttaaaatttggtgcaagcacttatattctaataactttaatttttttcgtcggattacaattgcgtaataatggtatctccttaaaagaagtcttctttaataaacgtggactttatacaggtattatcttcgtttttacttcgttgttaggcggaattctttctgcttatattctcgacttgcctattacacaaggacttgccatttcttcgggatttggttggtattctttatctagcgtaatcattaataatgcttggggacctgtttttagtagcatcgcttttttaaatgatctatcaagagaaataaccagcttatttattattcctttattgatgctaaactaccgctctaccgcagtaggtatttccggagcaacatcgctggattgtactcttcctattatccaacgttccggaggaattgaagttgtaccgttagcgattagttttggttttatcactaatattcttccccctattttattggtctttttttcctccatcccaatttagctaaaacgagagtaagacgataaaagtctcactctcgttttataagataaaatcatttttcatataattactcgactgctccgataagttaggaaaataattgttggctatttatatttatattcatcttgatagaataaacgagttaacagtaactttgatatcttatgtggggattagttaatatgatgaataaaaaaaatagttatagttacgaagatttgttagcttctggaagaggtgaattatttggtgaaaaaggacctcagctaccagccccccagtatgttaatgatggatcgtgttgtagaaatgaatgaagaaggagggttgttcaataaaggctatgttgaagctgaattggatattaacccgaatttgtctttctttggttgtcattttatcggtgatccggtcatgcctggctgcttaggtttggacgctatgtggcaattagttggattttatcttggttggataggcggtcaaggaaagggacgtgccttgggtgtaggagaagtaaaatttaccggtcaaattttacctacggctaaaaaagttatttatcgtattaatatgaaacgtgtaatcaatcgtaaattagtcatgggaatggcggacggtgaagttgaagttgacggtaaagtcatttacacggcaactgatttaaaagtaggattatttcaagacacctcaacgttttgattaaataattgctattgtgttaaaaaattgtagtttctgcgaattttacatttatagagttatctagtttaaaaaagtgcggttatttttattaaataaccgcacttttcttattacttcaattcaccacaattcaaacaatataagtattgccctttgggatcattaaatttatttaaaatacctaattgctcagtcattttctgcattgatgtagaaaagccgaataaatgggcaatatactgacgaagattatgttctgaatgttgtttagcatttttcatcaactcccccaataatgacggttctttttccgttagccaaacaacagaaaaatcttttatttcttctgaagatttctgtatcactaattctctagctttttcgactgcatcatcaaaactgcccagttgatctaccagtttatacgtataagcatcaaaacctgaccaaacttgaccttgagcaattttatcaacttgtgtttttgataaattacgcccacggctaacaacatccaaaaattgatcataaccatgctctatttctaattgaataatctcactgctgattttagataacgggctgaaatgtgatttcatcaccacatcagttgtcgcaacaccatcggcattcacaccaattttttgcatagatttttcaaacgttggaaacatggcaaaaataccgatagaccctgtaattgtattagggtcagcaacaatataatctgccgttgaggaaatccaataaccgccggaagccgccattgcccccattgaaacaacgactggctttcctgatttttgtaaattatctacttcttggcgaataatttctgaagcgaacgcacttccacccggactatttactcgcaatacaaccgcttttatatttggatcatcattcgcctcacgtaataattgtgctatgctatctccgcccacattttgttcatcactttcaccatcgacaatagccccttcaacatttaccacggcaatagcaggttgtgtaggttgtgcaaatcgatttttcaatattgccaaataatcctcaaattcaacaaaatccaacttatcatcagaattaactatccaacgtttaatgattttttctcgttcttgcgttaccgctaattctgttattaaaccacgctttttcgcatattcagtttgatttccgttcagtgcttttaattcgctaaggtatgttttactatccggtaacacctgtgctaatggaatatcacgattttcagccacaatttgctgataacttttccataattggttaagccaacggcttgtattttcacgacttttttctgacattttatcgagcataaacggttctaccgcagatttataagtacctacacgaaaaatatgcggtgtaatttccaatttattaaatagcgatttaaaatacaaattctctgcaaccataccttctatcgccacttcaccttgtggatttaacaaaataacatccgcataacttgccaataaatattgactttgcgtatagttatccgcataagcaatcactggtttcttgctggctttaaaggcttgaatagctttcccaatgtaagttaacgcaggaatatctttcccatcaaaataattgagatcaagaacaagtgcggtaatttttggatcttttttagccgcttgaatggcattaacaacatcaaacgttgagatttttctcggtacatgttgattacctaattccaaaagaagctcttgccatgccgtatcatcgctacgattatctgccaaatagccgtccaaatttaatagcaacgcccctttaaaatgagttaaatctactttattcgacatactcgaattaaccgaaaacactgctacaatcaataaaacgaaaaaaagaaatactatattcattacaacacgacgagcaaaattgagcatttgccagcacaatttgagaaaggtcaacatcactttcatattatcctttactaagttaaaacaaatgtcgtaccttaccacaatttccttttacttcatatcgatcaaggtaaaaatatgctagaatccaccgcacttttaagatgaaaaacaagatggaactaaaatggacgctctacaacttcttaccactcgtcattcagaaaaaaaattaatttcacctgctccaactcggcaacaacttgaacaaatttttcacgctgcactgcatacaccggatcatggaaaattacacccctatcgttttgttgttatagaaaaggaagggttgaataaatttacagagttactaaaagaagctgttttggaattagatcttggacaagagcggttaaaaaaagccgagaatttatcccaaagagcacctatgatcatcggtgtaattgccaaaataaatcctgatattgaaaaaataccggcatgggaacaaatgattaccgcaggttgtgctgcttacgctatgcaattagccgcaaatgcacaagggtttgataatgtttggatcagcggtccttgggttaaaggctctgctttgcgtcaagcctttgattgtgaaaaaaatgataaaatcattgcattattgatgcttggtacagcagaacaaaaaagtgatcgaggaaatcgagaattgaatttagataagtttgtgcgttatttatagattttatgtagcccaaattttcactgggctaaaatctccccttataattaaaaaataaatataactcatttttttaacaaggttaaaaactcttttctggtttctctgtcgtccaaaaatactccgcctaaagccgatgtcacagtgtaactattggtatctttaattccacggcattttacgcaaaaatgcgtagctttaacataaacggctacatcttccgtttctaaaatggtttggaatgccaacaaaatttgttgcgttagacgttcctgaacttgaggacgttgtgcaaaaaaagcaacaacacgattaattttagataaaccgatcacccatttttgcgggtaataagctactgatactttaccatcaatagttacaaaatgatgttcacaagtactggttaaagtcacatcatcaactagcaccatttcacttactttcatgcggttttcaatattagtaattttagggaaattagcgtaatctaaaccactaaaaatctcatcaataaacatttttgataaacgtgccggtgtttcctccaaactgtcatcagataaatctaaaccaatcagttttataacctcacgcatatgttgttcaataccttgacgacgttgatctttatcttgcataagatcaatcattggtgtttcaattcctttttcaaccaaagcattacgaaccttaatcgcttccggagataaattgctcatgactacttcccgtaaaatcgttatatcctttaaaaatgcctgacattctagcaaataaaagctgaaatctctatttattaggtataacaattactgaatttaaagtaaaatgtgagctgttttttcacattattacaaggatttctatgctatctcttgaacaagctttacagcaaatgctttcgcaattagcaactataaataaaactgaaacgctaacattggaacaagcagtggctcgcatttgtgcagaggatattatttcaccgattaatgtaccgtcttttgataattctgcaatggacggttatgcagtacgtttggcagatttgaaacattcaacaacgctatctatatgcgggaaatctttcgccggtaatccattcaacgagcaatggcaagaaaaaagtgttattcgaattatgaccggagcaatgcttcctgaaggtactgatgccgttgtaatgcaagaaaatgttacaataaacgaagacggcacagttactatcaatgaaatacctaaattgcaccaaaacattcgtcgtttaggagaagatataaaagtgggtgatattgcattaaaaatgggctcaaaattgaccgcactttcactcccgcttttagcctctttaggcatctctcacgtaaaagtttataagaaacccaaagttgctctattttcaacgggcgatgagcttgtatccgttggacagcctttagtacaaggaaaaatttacgatagcaatcgctttacaattcgattaatgctggaaaaatttccttgtgacatcttagattttggtattcttcccgatgatgaacaacttttcgagcaaactttttttaaggctcaaaaacaggctgatttagtgataagtagcggtggagtttctgttggagaggctgactttaccaaagctgtcttagaaaagtgcggtgaaattaatttctggaaaattgcaatgaaaccgggcaagccttttgctttcggtaaattaaataacgcttggttttgcggactgcccggcaatccggtttcagctttagtgacgttctatcaacttgtgcagcccgtaatagcaaaattaagtggctatacacaatggaaaatgccacaacaattaaaagcaatcagtgctacaaaattgaaaaaatctgttggtcggattgattttcagcgtggtttttaccaactcaatacacaagggcaaattgaagtttatcctgtcggacaacaaggttctcatctttttagtgcctttgtgaacagtaactgttttattcgtttggaacaagaacgtggaaatgtcgaagccggtagcatcgttactatagaaccttttagtgatattttaaactaggatctttatgcaaatcgaactctcaacaatagaagaattacgctataaccgtcaaattatcatgaaacaaattgattttgatggtcaagaaaagttaaaaggcacaaaaatgcttattgtcggcttgggaggattgggttgtgctgctgctcagtatcttgcttgcacaggtgtagggcatttaactctccttgattttgatactgtttctctctctaatttacaacgccaagtactgcataatgatgagcgtttaaatatgctgaaagtacaatctgctaaaatcgccctgcaacaactgaatcctcatattgaaattcaatgtattgcagaaaaattgaacgaagaaaaacttgctgaaattgtaccgcactttgatgcagtcttagactgtactgataatgtagaaattcgtaatcagctggatcgctgttgtttggctacaaaaacgcctttagtatcaggtgcggcaattcgtatggaagggcaagtttcggtgtttacttatgaagaaaatacaccaacttaccaacatttaagccgtctattcggtgaaaatacgctaagttgtgtggaagcaggtgttttatctccaatagtcggcattgtaggggcaattcaagccttggaagcaataaaagtgcggttaaatataggcaaaattttatcaggacgtttattgatgattgatggtttaaatatgaagatacgtgaaattaacattccgtctgaataaaaactcaatatccttacaatctctaagataatgctggattgcctaaaacacaggtttatcaatcaactgttttcaaagtagcaaagattcaggtagcacgccatcatctccacgatgtacccgcataccttcaacccgcacacgtcccgtcacacaatcagctatggcttttggtaacaaacggtgttctgcagctaaaactcgtgccgccaatgtttccggtgaatcatcatcggccacaggcacagccgcctgtgcgataatcggtccgcaatccatctctgccgttacaaaatgcaccgtacacccaactacacgacatcctgcttccaatgcccgacgatgcgtatccaacccagtgaatgcgggcaataacgatgggtgaatattaatcagcctcccagcataatgcgtgcaaaattctggcgtaagtatcctcataaagcctgctaaaacaacccaatcaggctgatattcatcgatttttctcatcaaagccgcatcaaaatcgctacgttcaggataatctttgtgactgaccacaccggtagcaataccttgttcttccgcccatgccaaaccagcagcatcagctttattagccaatactgccaccacatttgcaccctcaattcgagcttcaactacagcctgcatattactgccacgccctgaaattagaattacaatgttttgagtgttcatttttttccttcaatttttccttcaatcaacccagccgggattaattgctttgttgagatggcacaaacatcgttttaatcactgcaacttcagattccccctacattttatcaacccgttcgattcgaaaaagattcgaagtacgaacaacaaagatagtgaagaatatggattggggtagcccttaaaaggctatggctctatggctatggctatttgctattctccacccatttaccatcaacaaaataggcactccattttgttgttttaccatttttctctgaggtaacatattgacgtttttctttacgactaaagcgaataattgcctcattaccttcaggatctttaactggcgcatcagctaaatagcgtaatttttctggcaggcgatcttgatattgaaccaattcagccacttttgcaggacgactttctcgtgattttggaaaattatgtgctgacataaacacaccactcgccccatcacgcaatacaaaataagcatccgatttttcacattttaattcaggaaaatgtacaggatcctcttttggcggtgccacttccccacttttcaaaatcttccgagtattatcacaatttgtgcaacccatatatttaccgaaacgccctaattttaagtgcatttcggcaccgcacttatcacattcaactacaggaccttcatagcctttaattttatattcaccttgctcgaccaaatagccatcgcaatttggattattcccacaaatatgcaattttcttgtcgtatcaatcaaataactgtccattgcagtatcacatttcgaacaacgcttacgttccattaaggcttttgtttcagagctttcatctaaaacatttaataattccgcttccggaattaaatttattgtggttttgcaccgctctttgggcggtaaggcataaccggaacagcccaaaaaaacaccggtactggcagtacgaatagccatttggcggttacaagttgggcaacctatatctgttgcaaccaaactatttggtttcattcctccgtccaattcatccaattcagcttgtgttaattgttggctaaaatctttaaaaaattgatttaattcttctttccaatttttcttaccgtctgcaatttggtcaagtatattttccatattagcagtaaaatcataactcattaaatcagcaaacgattgattcaatcgatctgtgacaatttcccccattttttctgcataaaaacggcgattttcaactcgaacatagcccctttcttgaattgtggaaataattgctgcataagtagaaggacgaccaatccctcgtttttccaattctttaactaaggcagcttcactaaaacgtgctggtggtttggtgaaatattgttgaggttcaaccttagttaaacttaatttctctccaactttcactatcggcaactcttgatcttcagggtttctattcgattgaggtaatacttttgtccaaccatcaaagcgtaaaacacgtcctttggactttaactcataatctcctgattgtacggttacggttgtactgtcatatttagcggctggcatttgacaagcaacgaattgtcgccaaatcagatcatataaacgcactgcatctctttccattccctctaaactatctgccaattgtcttacatcagaaggacgaattgcttcatgtgcctcttgtgcattttcgttactggaatagaaattcggtttgtccggtaaataggcttgtccaaattcttgcacaatataattacgcaccatttctaaggcatctttacttaaatttgtgctatctgtacgcatataagtaatgtaacccgcttcatataaacgttgtgctaacatcatcgttttctttacgccaaaacctaattttgtgctggcactttgctgtaaagttgaagtaataaaaggtgcttttggttttgacgtcgttggttttatttcaagatctttgacgaaataatcggaaatttgtaaaaaatctaccgcacttctcgcctgttcgatatttttaggttcaaattttttcccttgaaattgtactacatctaaacgaataggtcgtttttgactgtttttactatcaacagaaatttcccaatattcttgaggttgaaaagccttaatttcacgctcacgctcaacgactaattttactgccacagattgaactcgaccggcagatagacctcgtgccacttttttccaaagtaatggtgataccataaaacctactacacgatctaaaaagcgacgagtctgttgtgcattaacacgatccaaatttaactgttcaggtttctcaaaagcttgtttaatcgcatttttagtaatctcattaaatactactcgactaaaacgactgtcttcgccgccaataacttcgcgtaaatgccaagctatcgcctctccttctctatccaaatcggtagcgagataaatatgatcaactttttttgctaaagatttgagttcagaaaccactttctctttaccgggtaaaatttgatacttagcttcccaattatgataaggatcaatccccattctttttaccaacgcattttgctctttttccgtttttatgcgttgtttttcttccgcacttaatcccttcgttgaaataggtttcgctttttcaccgctactttcacctaccgtaggcagatcacgaatatgccctacactggacttaactacatattgattacccaaatacttattaatagttttcgcttttgccggcgactcaacaattactaaggatttactcatatttttatttacctaattcgctgtatttttgtaaaattgcccgctatattgcttactatcttttgcaaggtcaacagttttttataaaaatgggtataaatgaataaactaaatgcagtttcaatcatctgtaaagttattaaaatatacagaacttttaaagctacaacgtaacaaagcatttaccccatcatgtttacgctaaactaaaagcattgattcattttgttatcagcttatatttgtactaaacgacacgctaaaaataaggtaagttaccttattttccctcacttccccagcgaagaaataaatcttgttctaattcaataccaaattgatcacatacacgattgacgctttggttaataatatcatctaagttactgggtttatggtaaaaagcgggcattagaggggtaatctgtgcacctatttctgccgcctgagtcatcaaacgtaaatgtcctaagtgtaaaggtgtttcacgtacacataataccaacggtttacgttcttttaagcatacatcagcagctcttgtcattaaatcatcggtatagctatgtgcaatacctgacagggtttttattgaacaaggcaaaattaccatgcctaaagtgcggtaagatccggaagaaattgccgcactaatgtcacgaatatcataaactttatcggacaattctcggacttgttgtaccgtaaattgtgtttcaagtgcaatagtctgtttcgccgcttggctaataataaggtgcgtttcaatttccggaagggattttaaaatttgcaacagccgaatagcataaatggcaccagatgcaccggtgatgccaataattaaacagtcttttttaagcttcattgtgcatttcgagattcgtggcatctttttcacgctttttctttgctttgtcattacgtaaatcggcaacttgatccaaatacgctgaggtaatatctccagtaacataaacaccggtaaagacagaacaatcaaaatctttaattgctggattttcttgctgaacagctctagttaaagcatcaagatcttggaatataagtttatccacaccaataagtttagcaatttcatgaacatctcgtccataagcaattaattcatttttagtaggcatatcaataccatacacatttggataacgaatttctggtgctgctgaggcaaaatagatcttatttgctcctgctgctcttgccatatcgacaatctgtttcgaagtcgtccctcgcacaatagagtcgtcaaccaacaacacattcttacctttaaattcagaagagatagtattgagcttacgacgtaccgcacttacacgctgagtttgccccggcataataaaggttcttcccacatagcgatttttcacaaaaccttgtcgataaggtttatttaaaatatgtgcaatttgtaacgcaatatcattggacgtttcaggaatgggaatcacaacatcaatatctaaatctttccactcttttgcaattttttgtcctaagttttctcccatgtgaacacgagccgcataaacggagacaccatcaatataagaatccggacgagcaaaataaacatattcaaagatacaaggtgttaacttaggactttcagcacattgttgtgcatataactgaccatcaaaagtaacataaacggcttctcccggtgctacatcacgaacaaattcaaagtcagcaatatctaacgcgatactttcagaagcaaacatatactctgttttaccgcttacctcatcttcacgttttcctaatactaacggacgaataccatttggatcacgaaatgcaactatgccataaccaatcatcattgcaacacaagcataagcaccacgaatatctttgtgagtagctctaactgcctcaaaaatatcctgcgtagataaagggtgtgttgtttgatccaaatgatgagccaaaatatttaacaaaatttccgaatccgaattggtattgacatgacggcgagcaaaggtaaagagtttttgttttaactcttctgaatttgttaaatttccgttatgcaccaaagttaaaccgtaaggtgaatttacataaaatggttgagcttcagagacactggaacttcctgcagtaggataacgcacatgaccaactcccgcattcccttgtaaacgtagcatgtgaacttgctgaaagacatcacttaccaatccatttgcttttcgtaagcgaaaacgattttcttcatctactgtgataatccctgccgcatcttgcccccgatgttgcaataccgtcaaggcattataaatagactgatttacagggctatggctaacaatacccacaattccgcacatatttcacgttccttatttattcaatgttgaatttattaaatttgaatttgcttgtatttgttcaaaaaaccattccacaataaagccaaagtgcggtattaattttgatgttttccaccaatcactctgtgcaaagtttgtgaaagaatcaataaaaaatagcaatgccgccacgattaatatacctcgtagcaacccaaagcaagcacctaataccctatctgttccggttaaacctgttttatcaactaactgactgataatgtagttaagcattgcaccaacaatcaaagttgctacaaataagattgcaatagcaaccgcattacgaacataaggtgcttctatttgagttaaataagttgctaaatagggataaaaattatttgccaccaaaaaagcaacaatccagctggcaagcgacataacttcacgcacaaaccctcgcaataaactgacaattatagagaataaaattattccgataatcattaaatcaagataattgttcattaggtaacctctaaaatcccatcaatttaagaccgcacttattctagcaaaaaaggaaaacgtttgcgtagtctaaattcacgctttatgcaaatttaatcgaaataaaaaagaagaaatcagaattgtcgtctaaaaatatagatggaaatatcaggaaatgtatcctttcagtttaaaatccatctgtctattcactaaaacactagatgagagatgttgagttagtcgataagccgggttctgtcttggacaatcattcatctaggcgtatatttacacatacgctcaagcaacctacccgaactctgagcgggcaactcattgagttcctatttggtcttgctacgagtggagtttaccatgccataaaatgttaccattcatgcggtgtgctcttaccacaccctttcacccttacctgatctcttacgagccattggcggtctgctctctgttgcactggtcgtaggctcacgcctcccggacgttatccggcactctgccctatgtagcccggactttcctctcgtttacttatgcctctaagtcgtttaaaaacggttaaagatttcaacaaaccagcgattgcctgactaactcgatgcggagtatagcgtaaaattcagataaaatatagagttcacccaaaacttgcggtaaaataaccgcacttttcaatgaggaaatgacgatgaattacttacaaatcgctcgaaattcgttagctgccgagcaaaatgctttagccaaacttagtcaaaatttaaatcaacagtttaatcaggttgttgagcttattttaaattgtgaagggcgattagttgttggcggaatcgggaaatccggacttattggtaaaaaaatggttgctacatttgcctcaacaggaacaccaagtttttttctacatccaacagaggcttttcatggtgatttaggtatgttaaagcctattgacattgtgatgttaatctcttacagcggtgaaagtgacgatgttaataaattgattcccagcttaaaaaattttggcaataaaatcattgcattaacaggtaacctaaattctactttagcaaaacatgccgactatatccttgatattagtgttgagcgtgaagcttgtcccaataatctggctccaacaacttcggctttagtaacgttagctttaggcgacgctcttgcggtttctttaattacagccagaaactttcaaccggctgattttgccaaatttcatccaggcggtagtcttggtcgtcgtttgttatgtagagtgaaagatcaaatgcaagttcgtttaccaaaagtaacagaaaacacaaactttactgattgtttaaccgttatgaatgaaggtcgtatgggggttgctcttgtcatggaaaatgaaaatttaaaaggtattattaccgatggtgatattcgccgtgcattaagtgcaaacggaactaatacacttaacaaaacagccaaagatcttatgacttccaatcctaaaactattaactataatacttatctgtctgaagcggaaaactttatgaaagagaaaaaaattcattcattagtcgttgtagatgatcagaataaagtgataggtttagttgaattttcgagttaatcccatgatgttattaaatgaaaaattacaaaaaattaagctggttattaccgatattgatggtgtactaacagacggcttattgcattatgatgccaacggggaagtaatgaaaagtttccatgtgcgtgatggactgggtatctgtatgttaatcaaaaatggcattcaagttgcagtcttatctggtcgagactcccctatcttacgtaaacgcattgcagacttaggcatcaatttatttttcttaggtaaattagaaaaagagagtgcttgttttgaattaatcaaaaaagcaggtgtaacacccgaagaaactgcgtacattggtgatgatagcgttgatttacccgcattttccgtttgcggattgtcttttgccgtaaatgatgcgatggactatgtgaaagattgtgctgatcatattttgagtttacccggagggaaaggtgcctttcgagaagtgtctgatatgattttaaaagctcaaggaaaagcaagtgtctattccacagcacaaggtattctcaaagcagttaacaagatggtgcaataaaatagataatgaaaataacagtccacatacaaaataagcgggctgttacttgtctgtaaaatatctctaaacacaactaaaatccccgcaagcaacgtaaaaaatacttttcacattctacccattcattcattaatttaataaccacactatcgatcaccgcacttacataagctaaaccttacatcataattacctattcgtattctaaataacaatagttattattaaaaatacccttttaaattaataacttataaaaaaataaaagttgcattccatgaaaaactgattaaaataaaacctgttttattcatcaataaaaaaggaactcgctatgctaaatcaagctattattactaagttaaatgaacaaattaacttagagttttattcatctaatgtatatttacagatgagttcatggtgtgctcataacggctatgaaggtgcagctgcatttttacttcgacatgcagatgaagaaatgcaacatatgcataaattatttacttatgtaagtgaaacaagtggtatgcctctgttaggtaaaattgaagcacccaaaaatgattacaaatctttaaaagaaatttttgaaataatcttagaacacgaaaaatttgtaactagtaaaatcaatgaattagttgaaattacttttgcaaccaaagactattcaacatttaacttcttacaatggtatgttgcggaacaacatgaagaagaaaaattatttaccggcattattgataaattcaatttgatgggcgaagacggtcgttctctttactttatcgatcgtgatttacttactttataatagataggacaaaaatatgttatcagcaaatgttatcaaattattaaatgatcaaatgaatttagaattttattcttctaacctgtatttacaaatgagtgcttggtgtgagcaaaacggttttgacggaacagctaaatttttagccgcacatgcagtagaagaaatgcaacatatgcgtaagttattcacttatttgaatgaaacaggtgcttcggcaatcattacggctattgatgaaccgccacatgaatttgattcattaaaacaagtaattgaactaacatacgaacatgaaaaactcattacctgcaaaatcaatgaattagtcggaaaaacctttgaagagaaagattattcagctttcaatttcttacaatggtatgtagcagagcaacatgaagaagagaagttatttagtggtattttagataaaattaatcttcttggtgaagatggtaaatgtttatatctaatagataaagaccttggtgatttgacaagtaaagtataatctatagaagatcaaatctaatctggcagtccctgtttaaaattatcatatctgtcagattagtttgagcttaagttttttctatctaagtacattttccatcaagtgatgttgctattaatctctcacttaagcacgtttttgtgggattataataaagctctctttttgagttactatgccttttaccaaaatgagtaaaaaaataatcatttgtagaatcatactaatgacagtttaaagatatcacttgatagtaattgacaatattcagtagacagtcctttatctgtgataatttgtgtaaagttattaagttgagttgcacaaaataaggaatattttccatatttactgctatcggcaactaatactttttgtttggcattttgttggagcattctttttaaatgagttttctcttctgtaggtgcggtaacacctttttccaaactccaagaattacaacttacaaaagcaatatcaggattaatgttattcaataaagtcaggctatggttaccgatacaggattggctactattatccactcttcccccggttatggtcaattctatttgtttatattcggaaagtaataaagcgatatgcagatcagtcgtaatcactcgaagtggcatatgagcgattttttttgcaatgcacaaagttgtagtacctgcatctaatacaatagagtctcccggagaaatgagagaaacggcatattcggctatccgctctttttcagtaatttgcttaagttgcttttcatttgtggttggttggaatggaataaagtggtttaaacttactcctccgtgtgtacgaattacaacaccttcttcatctaattttattaaatcacggcggatagttgcaggagaagcctcagtaacctttaccagctgttctacggtagcaatattatgactttttagaaatagtaaaatctgctctagacgatttttagacatataaactctcttatttgtaattattttactataaataattttttgaaaataagatagtgaaaattaaagaacctaaaacattattgctttaggttctttagtattatttctccattatgtggcttaaaagtacttcgcttccaaatccaccggatttggtcattacaacgatgtctgaatagttaccttcttcaattaagcataaaggcactcccggtactactgcatataatacgttcatttcagttacattcatttgatccaataatgctgcagccccatctccaccgaatagtataagactatcaaatttttcattatcaaggcagaatttacttaaatcagctaagtgttgagaaatttctttagcggtttcagtaatatttgccgattttgcatttacgacttttgctgggtttgctcgaataatcacattatccttactaaaacgtattagagcgtttaattgtagttttagtgaatgttctgactgcgaatagttcatcaactgcgaaggtgaaggatgaaatacaatcgattttccacctaaagttgaaacatattcatcaacttgaagctggcttgtttcgtgaattgatgttactacaattaatgttctacctaatgtaatctctcgctttggtctcggtttattttgaatatttttcaatttctgtgctaatccagctgagccaacaggaataattttatttcctatatggtttataacttttgcaataattgcaagatcttcgtgcgttttagcatcaataacgatctgtttatattcactattttcaatagatgcctgcaaattatcgaccgtatcacacggaattacttgagcatcaggcaataattcttgcannnnnnnagacagtacagggcaaataggatctttgcctgaagcggtttcctttacaggaacactattaacatataaatgaccggcttctatcgttctccccatttctggatatgcaggacaaataattgctttaacgtccggatataaactagcccacgcttcaatagcaccttcaatttgatattttacagagcctctcattgtagaatcaattttgaggtaaatttgcccaataccattttggatagcattactaattgcaatttgagtttgttcttttgccttttctccaatagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaatgatcttttttaatcatatagattttatttaatctaatggtaaggattataaagcagattagaaaagtaaaatgttatttaatttgaataaacacttccctttttagcaaaaaacggtatcattacgcctcttaaatgtaaccctacatttaagtttgtttccaacctatcctatcttgggacaaatagggtaaaaacaaaaaagctggaacgctttttttaataagtagcgagtcaaatgccccatggcgtctagtctctcgggatttgagagcttaggcttcctccgcaaggcacccgacttatttttttcacctcttttagaaggtttatttcaatgacaattaaaacccctgttcaagcaactcttgcttcaaatcaatactttttagatcgccaagatataatggaatcaaacgtgcgtagttacccgcgtaaactgccgtttgcttatcaaaaagcacagggcgtttgggtaactgatgttgaaggtaatgaatacctcgatttcttagctggtgcaggaacgcttgcattaggtcataatcaccctaaattaattcaagcaattaaagatgttttagacagcggtttgccgttacattctttagatattaccactccattaaaagatgcttttaccgaagaattactctctttcttccctaaggataaatacatcttacaatttaccggtccatctggggcagatgccaacgaagcggcaataaaattagcgaaaacttataccggtcgtagcaatgtaattgcattctctggaggtttccatggtatgacacacggtgcattatctttaaccggtaacttaggtgcaaaaaatgctgtgcaaggtttaatgcctggtgtgcaattcatgccttatccacacgaataccgttgcccatttggtattggcggtgaggctggtgtgaaagcggttgaacattattttgaaaactttattgaagacgtggaaagtggtgtggtaaaaccggcagcagtaattttggaagctattcaaggtgagggcggtgttgttccggctccaatcagcttcttacaaaaagtacgtgaagtaacccaaaaacacggcattttaatgattgtggatgaagtacaagccggtttctgtcgttcaggaaaaatgtttgcctttgaacatgcaaatattgaacccgacattgtagtaatgtcaaaagcaattggtggtagccttcctttagcagttttagctatcaaaaaagaatttgatgcatggcaaccggcaggacatacaggcacattccgtggcaaccaattagcgatggcaacaggctatgtttctctcaaaattatgcgtgaagaaaacttggctcagaacgcaaaagagcggggtgaatacttaactaaagccttaactgaattaagcaaagagtttccttgtatcgggaatgtgcgaggtaaaggtttaatgatgggtattgacattgtggacgaacaccaagccaaagatgcaacaggtgcttacccacgtgattgcgatttagcggtagctattcaaaaatattgttttaaaaacaaattgttactagagcgtggtggtcgtggcggtaatgtggtacgtattttatgtgcggtaaacattactcaagcagagtgtgaagagtttattaaacgcttcaaacaatctgtagccgaagctgtgaaagcggtacgtggttaatttttgataaaacaagcggtcatattttgcaaaaaatttgcgaattttgaccgcttgaattgtatatagcattgaatgagataacaaaaatgacagatatttccaaacacagacaatcgctattttgtagcgatccacaatctattgcggattatgaaaccgcaatgaacaatgcggtacaagcggtatcaaattggctaaaaaatgaaaaaatgtacaccggcggttcgatcaagcaaatgcgagccttgattgacggcttcaagccgaccaaagagggagtgggagtgcaaaaatctcttgagcatttggtagagattttcctcaacccaagccttaaagttcaccatccacactctttagctcacttacattgcccgacaatggtgaccagccaaattgcagaagtgttaattaatgcgactaaccaatctatggactcttgggatcaaagccctgcgggatctattatggaagagcatttaatcgactggttacgccaaaaagtcggctatggtgaaggtacagctggggtgtttacttcaggtggtacacagtcgaatttaatgggcgtattgttagctcgtgactgggcgattgcgaaccgttggaaaaatgaagacggctctgaatggtcggtgcaagcgaatggtattcctgctgaggcaatgaaaaacgtgaaagtggtttgctcggaaaatgcccacttttcggtacaaaaaaatatggcgatgatgggaatgggcttccaatcggtagtcactgtgccgtcaaatgccaatgctcaaatggacttagaagcgttagccaaaaccttagcagacttaaaagctgatggtaaaatcgtagcttgtattgtagcaactgcaggcacaaccgatgccggtgcgattgatgatttaaaagcaatccgcaaattggcggacgaataccaagcgtggttacacgttgatgctgcttggggaggtgctttattattatcgaaagatttccgtcatttcttagatggaattgaattaaccgactcgattacactcgacttccacaaacatttcttccaatccatttcttgtggggcattcttgttaaaagacgaggcgaattatcgtttcattgattacaaggcagattacctcaactcagaatatgacgaagaacatggtgtaccaaacttagtagcaaaatcactgcaaacaactcgtcgttttgatgcgttaaaattatggtttacggtagaagccttgggtgaaaatctgtatgcttcaatgattgatcacggtgtgtatttatcaaaagaggttgaggcttacattactgctaccgaaggcttggaaatgttagtacctgcacaatttgcctcagtgctgttccgtgttgtgccgaaaggctatccggcagaatttgtggatacattgaaccaaaacgtggctgatgagctgtttgctcgtggtgaagcgaatattggtgtcacgaaagtcggtaacaagcaatcactaaaaatgacaaccttaagcccgattgctactcttgaaaatgtgaaagccttattagcacaagtgttggcagaatcagaacgcatcaaagattctattgtaaacggcacctatatcccgcctattgattaaacgattggcaaaattatacctaaatcaggccgcttatcagccttgaattggttaatgagcggtcaattttttgactttttataaaatctattgaaagctctattgttcatcacaagttaattaatcgctaatttcctcaatacttcacccaacccactttgacgctcagtcgctttactcaccgccatattccatactttgcggtcagaaaaaacagtaacttgattgattgctcttgttactcctgtataaaccaattctttacataaaacaggattggcttcacaaggcaaaaccacaaaggtatgagaaaattctgaaccttgggatttatgaatagtcatggcaaatgccggactatgctcaggaatacgacttgctaattcagccttaccattttcaaaccaaaaatgcccttttaagctaccatcaggttgtttttctgctaaatacaacgcaatatcaccattagccaatccgagacggctattattttcagtaataatgattggttttccaatatagaaatcacgactatgattaaattgcacaagtccttttttctttaattgttctgcaataagttgattgagattttcgctccccaattctcctaccctaagtgcggtcaaaaatctcactttattgaatgcggcaaaaatagccgcaatatgcagtttaatcggtaagttattttcagtaattttgtgaataagttgcaaatattcttcataattttgcaccgcactttgcacgaccaattgactgcaatattgagaataatggtgtgctaatggctgttcatcaatattagtttgttcatattgtgtagaataatccactaaattgatttctcccgtgtcgtttgtgttattttcttgttgatattgatgaaataattgccaactttcagcaattttttgttggttaattaattgagctaatttaccaatataaggatgtttaccgaaacgacgactgccttctaagttgcataaacaatcacgaataagattttcatctgcatgatgttctaagttttcccctgttgtttgctgtaaataatctgctaactttgaactaattgaatattgtctaaaagtacctaattcagccaaaatcgctcctgcttcaacagaagataactgatccttatcgccaagcaaaatcagcttacaactcggtttcaaggcttgtaataatttcgccattagaaacaaatccaccatagatgcttcatctaccaccaagagatctatcggtagtggattacgtttattatatttcgtcttttcttcaaaaaatcgcacaccaattaaactatgaatagtttcagcattaaaaggaatagcattttttatatgttcactaactttaattaactccttttttgtcaataaattaaaggaatttttcatactaatttttaagcgttctgaagcttttccggttggggcaaccaggcgaataactaattttccctctgccaactcctgtaatgccaataataatcgagtaactgttgtcgttttacctgttccgggtccacctgtaatcatgcaaaaaggttgatgaattgccgttgctacagcaattttctgccaattatgcttttgttttaaactattatcttcatgctctaccgggaagtatttttgtaagatgccttgaattttttctatcggatatggttgattttctttctgttttattgttcgaattaaaaattcggcaattcgatgctcatcttgccatgtgcgataaaaatataggcgattattttgtagcaccaagggctttacctcattaataggatcttgagtaaatgcgatatgattaatgagtaaattttgccattcagattgtgtaatattccctattttctctttaatatcaataaggtaacttttttccgcataaggtaaattaaacagatttctaaaagaaaaattttctaattttaagcacgtatgtccttgttggttatgaaaattacaaagtacggcaagtaaaatagctaaatttttaacttgtaatgaataatctaattcccgttgtttatctgcaatcaactttgcaaaataataatcaccggcttgaataaatttcctttccttaagttgatacaaaatatttagcattaaaataaactctccaattcagaaatcaaacgccaatccggtttatcaaaaaacactccggaattatcttttccattcattccacgtaaaaaagtataaatcacaccgccgaaatcacgctgataatcatactttctatcccgctcttttaaataacgatgtaatgcaatggtataaattaaatattgccaatcataatgactattacacattgcttggattaaattttcttgctgatagtcttggggggaatagcctaataaattagacttataatctaataagtaatacttgccttcaaaacgaacgaccaaatcaataaaacctctcaccatacctttaattctatccatcagtatcggtgatgacggtaaatgatgatacttacttaacagccgattaaagacattttcattaaatgattgatttaatttcaaataaaattgcatttcttttaaacaatcttgcgacttgatattgcctaaagtaaagcctgcaatatcctgttttaaaggcgtattaaaaatcgcatttatccattttttcaatggattttgccattcatcacttaattgtaatgcctgacaaagtttagataattgctcatcattcaatgcctgcatcatattatatttctcaaaataacgatggaattcgctaccaacatggacaccatgaggaaaatcaaacggtgaaaaacctacaggataatcagagtctgcactcaacttcatatcaaaagacgctgacatatcatgaccattttctttcacatcataatctcttgcttgatcaaaaactccggatatttcaatctgcagtgctttttgtcgagaacttaaagatctgttacgttgatgacggtaggtcatttcagtaaaacttgttacagtccaattacgctcaatcttgccatgaaattcttccgcttcaaccggcgacaatgcctgttgcactgtaatatactcatttctccttactaataattttttatcttcctctatttcaacacattgttcacctaattcctcaattattggacttaacaatttttttgcatcatattcatcatcaattcttttatttacaccaatttgtcccttagttaatacataaagtaacgcattccattttttctcaaaaacgcgaggaagattaataacaatctgatatttcgctcgagtaagtgcaacatagagtaaacggatatcttccgccatacgctctttttcaatttcatcggaatgttgcttatccatatcccataacacttgttcttgattttcatcataataagtattaatggcattatctcggaatagggacggcttacaaataaaaggaatccaaactaaatcataagcaagccctttggatttatgtaatgtaacaatcttgactaattctcgatcactttctaaccgaatttgttcttccaaacgttcttcgccttgaatctgtttctcaaaccaacgaactaaggaggactcggtatcatttaaacgggtagcctgttgcaataactcacttaaatgccacaaatcagtcatttttctctcaccttgttccatcatttgtaaattttcattaattttttcaactgcaaataaatgatgcaacataggtaaaataccctgcctgtgccattgttgttggtaggcaataaatcgctcaacacagttttcccataagttctcatcttgcttaatttggaatatttctgcaccggttttagcaaaaagagcggtactcaacgcatttaaaatattattttcatttaacggatttaaacaagctcgtaaaatatgcaacagttcttttgcagtgatactatcaaaaacgttactacgatctgaaagataaactgatgcaatacctttatcccttaaggctttttgtattttctccgcttgagtaaaactactgactaaaactgcaatattttttgcttttagtggtttgttatctaaaatagcttgattttgtaccgcactttgtagccattgctcaatagataaagcacaattttcagcaagttgtgtgtcattgttgtcagtcaaataacctcttaatgcaggttcaattctcccatttaagcaaaatcggttgggaagaagatttccttgagtgtcataatataatcctttagcaacctgttgaaatggaattttttcatgtaaaaaaggaggattttcttgaaaatcaaaaagataatttatcgtctgaataagaggttgtgtagaacgccaattttcgcccaaactaaatcgatattgtgcttgttccgttgctttcagataggtaaaaatatccgcaccacgaaatttataaatagattgtttaggatccccaatcataataaagcccgtatttttcaccgcacttttaatataaatttgataaaaaatatcatattgctgttgatctgtatcctgaaactcatcaatcatagcaaaaggatattgatggcgaataagttgtgctaatttatctccttgtggttgatataaagcattgcgtaccagacgtaaaagatcatcaaaccccttttgttgatgcgtaagtttataatccattattttacgatttaattcatgaacacaatggtataaaagtacagaaaaattatttgaaatttgagtaacttcattggtcactaagttttccaattcggaaaataaatcatgcgatactaaaggttcttttttatctaattccaattgataaaaatattttgccgcctcaggttgctgaatatcctcgttttctgcccatactcgcattttattaaaacgactttcaaaccaatctttacgccatttttttaaagcgacaagctctcttaacgctttttcattttctaaccaacgttgtttaaattgatgaattttactaagttgaggctcaacttgagtatgtaaaaattgctgcagagaaatctccaataagtgcggtttttgggtatttacttttggcggctgagaaagatatttataaacgtaagataccagttgcctcggcgatcctaattttttgaaaatgaagtttgcgactgacaaaggctgatgataaaaattttcacgccatagctcatttgccaaacgttgaattagttcagattcatcactcaccagttccatattaaaatgtacccccgaattaaaggcatattgcattaatactcggcgacaaaaactatgaatagtcgaaacggcggaaatatccaaatttcgttctgctaaagttaaacgatagactgcaagatcgatgtctttaatataaggcagtaattcttgcagaaattgatcttcaagtaatgttttattttgatgttgctgatattgaattaacgcttgttttgtttgataaatacgttcccgaatacgttgctttaactcttgtgttgccatttctgtataagttactaccaaaatttgatcaacttccaatgcctgagaaaaattattttctcccgcttgtaataacaagcgaatataaagagaaacgatggaatgagtttttcctgtaccggcagatgcctcaattaaactgaccgcacttaacggagtagaaataggattaaaaggttgaaagacggatatgtgtaaggaagaatattgatcttgtaagctggtcatgaaattaagcatcttcgatagaacatagaatattgactaatttacctaacctaaactctttttgcaaaccttcaaaccgatgtaaaaataaaacggagcagatcttccgctccgttctcatgttatttgccattcaaactatctaaattacgtaatgcttcaatacgtttttccaatggaggatgacttaagaataaagaagcaagtcccccacgttttccattgatggcaaacgcagctagctgcccctccatttcttgtggctcatgcaacgttttcaaacgttgtaacgctgcaatcattttatgtttacccactaattccgctgaaccggcatcagctttaaattcacgatagcgagaaaaccacattgcaatcatacttgctaatacaccaaacacaagctcaagaaccattgaaatcataaaatatataccttgactggtatttccatcacgatctgtagcaacaacttttgccagcattcgagaaataaaaatgacgaacgtatttaatacgccttgcaacaaagtcatcgttaccatatcaccgcttttaatatggcttacttcgtgagctaaaaccgcttccgcctcatctcttgtcatagcatttagtaatcctgtactcacggcaacaagtgaattcttttttgtcgcacctgttgcaaaggcatttacatccgctgaatgataaatggcaactgtcggcataggtaatcctgctctttctgcctgtgaatgcaccgtttgaagcaaccaatgttccgtttcattacgaggttgttcaataacttgaccatttaccgaacgtaatgccattgattttgacatcagtaaagaaataatagatcccgtaaaaccaaataaagtagcaaaaatcaacaatcccaccgcatcttggcgttgaataccggtcaacgtcaaaataatgttaaaaacaaataaaacggcaaagttagttgctaaaaatagcaaaattctcatcataataaagttcctttacattaaaaattccctgcctatgataaggacaaaatattgaaactcaagggtaaaataaaaaaatttgttaccataaactcatttgtttttgctcaattattgtaggaatactgacatataatccaactaaacgcacagaacgattttgatgtcgttgccaaatttgagttaatagttttacaaaattttcttgcgaacatttcaccgcacttttttctaatgttgttatttggaagtcataaaattttaatttcacacctattttacaaaaacattctaagggaatagcaggacaagtctttttaattcgtttcaataaaagaggataaaggctattaataacctcaataccttgttcaacctgcaaaatatttttcattaaagttcgttccagcccgatagatttaggttcacgatgagactgcacagggcgttcatctatgccttgactaaattgccaaatacgatgtcctattttaccaaatcgatcgattaaaacatgatagtcaaattgttgaatatccgaacaagtttccaatcccatttgctgtaatcgttgcgttgtcacttttcccactcccggaatttttttcagtggaagttgcctaataaacgttgcaacttcttcaggcttaataacaaactgtccattgggcttattctgatctgaagcaattttagccaaaaattttaacggagcaataccggcagatgccgttaatcccgtttcctgagtaatgatttgtctaatttcttctgcaatccacgttgctgagcctgaacatttttgacaatccgttacatccaaataagcctcatctaaagataaaggttcaattaaatccgtataacgcaaaaaaatgtgttggatttgttgcgaaacctgcttatataaaggcatatttacagctaataataccaaatcgggacaaagtttcagtgcttgcgatgttggcattgcactatgtaagccaaactgacgagcaacataattacaagtacttaataccccacgctgattagccaatccgcccacagcaacaggtctatcatacaattccggtttatctcttatttcaatagatgcataaaagcaatccatatcaatatgaataattttacgaaacatcattgttaaaagtgcgattaaaatgttcaaatttgaccgtattctaacatttttactgtataaataaacagtttttgttgtttttcttatttaacatcatttatacctatttttctccaagtaatgtcttttagctatgcttttttgaaagctgtacattttattctccttctttcctatacggtcctaccagctaaaatttttgacaaaatcactgatttttttgcaaaaaaggcatagaatacaggacgcatttgcaccttaatagaaatgttattaaaatgcggtgttattttgtgctaaaccatttttaggaaaatcagatgagccaagaatttttggattttgaactgcctatcgctgaattagaagcgaaaattgaggctttacgttcagtttcacaacaagatcaacagattaatttagatgatgaaattactcgtttacaaaagaaaagtgcggagctaacgcaaaaaacttttgctaatttagatgcttggcaggtatctcaaatggctcgccaccctaatcgtccttatactttagactatattgaacatatttttacagattttcaaacactggcaggcgatcgtgcttttgctgatgatcaagcaattatcggtggattggctcgtctagaggaacgtcccgttatgattatcggtcatcaaaaaggacgtagcattaaagaaaaagtaaaacgtaactttggtatgcccgcacctgaaggttatcgcaaagcattacgtttaatgcaaatggcggaacgattcaagttgccaatcattactttcatcgacacgcctggagcttatccaggggtcggtgcagaagaaagaggtcaatctgaagctattgcacgtaatttacgtgaaatgtctatgttaaaagtaccgatcatttgtacagtaattggtgagggcggctcgggaggtgcgcttgctatcggtgttggtgataaaatcaatatgctgcaatacagtacttactccgttatttctccggaaggctgtgcctcgattttatggaaaagtgcagaaaaagcctctacagcagcagaagtaatgggcttaacagcttctcgtttgcacgaattaaaactaattgatagcataattgaagaacccttaggaggtgcacatcgcaactatgacactatgtcaaataatctgaaaaaacgtttgttagccgatcttgccgacttggataaattagatcaagagactttattagatcgccgttacaaacgattaatgagctatggttattgctaattttataaaaatagggcggtcttataccgctcttttctatttatagatatgttatataggaagaaaaaatgaaaaatattctctcaattcaatctcacgttgtttatggctatgcaggcaataaatcagcaacatttccgatgcagttgctaggcattgatgtttgggcgttaaatacagtgcaattttctaaccatacacaatatggaaaatggaccggcatggtcattcccaaagaacaaattggtgaaattgtacaaggtattgataatattggagaacttcatcaatgtgatgctgtcctgtccggttatatcggctcagcagaacaagtagaagaaattataaaagcctttcataaagtaaaagaacgtaatccaaaagcaatttatttgtgcgatccggtgatgggacatcctgataaaggctgtgttgttgcagatggtgttaaagaaggactgattaaaattgcgatggctcaggcagatattattaccccaaatttagttgaactaagagaattaagcggattagcggttgaaaattttgaacaggctattgaagcagtaaaagtgattctaagtaaaggtccgaaaaaagtattggttaaacatttaagtcgtgttggtaagaatgctgcacaatttgaaatgttattggcaaataatgatggtatttggcatatcagtcgcccattacataatttcaataaagaacctgttggcgtaggtgatttaaccgctggattattccttgcaaacctactgaatggaaaatcggatgttgaagcatttgaacatactgcaaatacagtaaatgacgtaatggaaacaacacataatgcaggcgtctatgaacttcaaactattgctgctcgtgaatggattgttaatccgaaaagccaatataaagcagtaaaaataggttaatcttattaaattgtaggggttattactcctacttttaatatttccaagctcaatagatttcgatcggaatccctatggatttattacaacagttacaaaatcagttaaatcagtttccctctcatactaaacttctactaggatttagtggcggactggactcaacggttttgttatctttattggcaaaactcagaaaaaaacaaccgcacttatccttacgggcaatccatattcatcacggattaagtcaaaatgcagataactgggctattcattgccgacaaatttgtcagcaactggatatttcttttctgtgtgaaaaggtgacgattaatcctcgtaaagggattgaggctgatgctcgtgaagcccgttatcaagcgattgctaatcatctacaagacaacgaaattcttgttaccgctcatcatcaacaagatcaaacagaaacctttttgttagctttaaaacgtggcagtggcttacagggattgggggcaatgcaaatacagagtgttgtttttaatctgcctatttttcgcccgcttttacattgcacaagacaacaacttgagcaatatgctaaaacagaaaaacttagctggattgaagatgaaagtaatgctgataatcgttatgaacgtaactttttacgtaatgatattttgcctaaacttcgtcagcgttggcaatctattgataatgcggtacaacgtagtgctcaacattgctttgaacagcagcaactgattaatgaattgcttaatgatgaatttaataaaatttacgataaattcgaccgcactttatccattgccaatttcgctacttactcaattttaaagcaaaaagccttactacgaacttggttacaacatctccatattttgatgccttcaacaatacagttggataatattatgagaaatatgattcaagcacaagaggatcgtaatccgacatgtagacttggaaatcaggtcttacgccgttatcaaaaacgtctttatgctacgccgatattacaagatttaagtcatattcgcctagatattcaagctaacgaatgcattaatttaccggataatttaggtgaaatttgtttactaaccaaaaatgagcatttgcaggttacatggcaagataaacagattttattacccctgacacaggaaaaaatagaaattcgctttcgttattccggtaaagttaaactcccgcaaggatttcatcaagaaatgaaaaaatgctggcaagatcataatgttcctgtatggcaacgcacccgtattcccttgattttttatggcaataaatttaaaagtgcggtaggtttttttaataattgtgagtaaaaaaataaccccatcttgatggggctattttaagaaccaatcctatcttaacgccaacctttaaactgattaattaaaccattggttgaactgtcgtgactattgatttgctcatctccaaccagttccggcaaaatgcggttagcaagttgtttacctaattcaactccccattgatcaaaactgtaaatattaaaaattaccccttgtacaaaaattttatgttcgtacatagcaattaatgcacctaacgtgaatggcgtaattttttgcactaaaatgctgtttgtcggtttattaccggtaaaaattttaaacggtacaatatttttcacttcatctaaggacttccctgcttgaataaattcagcttcaacttcttgttttgttttaccaaaagcgagtgcttctgtttgtgcaaagaaatttgaaagcaatttattatgatgatctgacaacacattatgggtttgtgctggggcaataaaatcacaaggaataatcttcgtcccttgatgaattaattgatagaatgcgtgctgaccgttagtgccaggttctccccaaataataggaccagtttgataattattaatcacttgaccactgcgatctacatatttaccgttagattccatattaccctgttggaaataagctgcaaaacgatgtaaatattggtcataaggtaacatcgcttcagtttcagcacctaagaaattacagttccaaataccaattaacgctaacgtaatcggaatattttgttccattggtgcggtgcggaaatgtttatccatttcatgtgcaccagctaatagttgctcaaaattgtcaaacccaatagaaagtgcaatagaaagtccgattgcagaccataaagaataacgaccgcctacccaatcccaaaattcaaacatattgtgagtatctataccaaacttctccacttcttttacattggttgaaagtgcagcgaaatgcttagctacttggctttcatcttgtgcagctgctaaaaaccatttacgtgcagaaatcgcattagtcatagtttcctgtgttgtgaaagtttttgaagcaactaaaaataaggttgtttccggatttacttttttcaacgtctccgctatatgcgttccatcaacattggaaacaaagtgcatggttaaatgatttttatagggacgtaatgcttccgttaccatataagggcctaaatccgagccaccgataccgatattcaccacatcggtaatcgctttaccggtgtaacctttccaatcaccggaaataacacgttgacaaaaagatttcattttcgccaacactgcatttacttccggcataacatctttaccatctacataaaccggtgtatttgcacaattacgaagtgcggtatgtaatacagcacgattttctgtacgattaattttttcaccattaaacattgattcagttgcttcattcaaagcacattctttagctaactgacgtaataaagataatgtttgttgattaatattattttttgaataatccactaaaatttgttcggcaaattttaacgaatagtcattaaatcgagtcggttcttgctcaaaaagttgttgaatagtaacttgatctaagtctttttgatgttgctctaaagctttccacgcattagtttgagttggattaatattttgcatcatttttcctctctatggtttaaaaatttaatcaatatattcgatcaatactctaggtgttaatttagtgataagttcatagcttatcatcccgctaattgcagaaatttcctcaataggtaattcctttccccataaaataacttcatcacccaccttatcttgactttcaataccaagatctaccgttaacatatccatcgatacacgcccaacaattggtacttttctgccattaatatagaccggtgtaccttgaggcatatcccgaggataaccatctccatacccaatagctacaacgcctattttggtatctctctcactaatccaacttccaccataccccacaggttcaccttttttatgatttctaatagtaattaatgaagaagttaacgtcatagccggaatgaatccataaacctcagcaggcgtattattcggcgagataccatacataataatacctggacgaatccaatctaaataggcttgctgccaaaacaaaatacctgatgaggcaacaatagatcgctcaccttgtttaccctcggtaacttgtaaaaaacgctctaactgaatttccgtataaccacacatcaattcatctgcccggctaaaatgactcaaaaacccgatttcttttacatttgaacattgaacaagttgctgataaaagtcttctacctgttcaagatctacacctaaacgatgcattcctgtgtcaattttcaaccatactttaattttattcggcaacttggctttcttaagctcataaagctgttcttgattatggataactgtttgaatgttattaacagcaataattggcaaatcatcctcggaaaaaaaaccctctaacaataaaataggtttagtaataccttcagcacatagacgtaatgcttccgataatctagccacaccaaaacagtcaaccagatgatgtagagtagaggaaacgaactccaaaccatgtccataagcatttgccttaacaattgcaatgactttactgtttttggctttttgcttaataacttgaatattatgttttaatgcaacagaactaatcctggctgttggaggtatgacattcattgattcgactctaatcttattttgtataatactgcggtatatttgctaaattatcaaaacgtgaatattgcccctgaaaggctaatttcactgttccaataggtccattacgttgcttaccgataataatttccgcaatgcccttattatcttccgttgtttcgttataaacttcatctcgataaataaacataatcaaatccgcatcttgttcaatggatcccgattcacgcaaatccgagtttataggtcgcctatcccctctgttctccaatgtacgatttaactgagaaagtgcaactacaggaacttttaattctttcgctaatgcttttaaggaacgagaaatttctgcaatttctaaagtgcggttattttcaaatcctggagctcgcattaattgcaaatagtcaaccatgattaaacttaacccgccattttctcgatacactcgtcttgctctggagcgtaattccgttggcgttaatcccgaagaatcatcaatatacaagttaggtttttgcttaaacatcccaaaggttccggaaattttagcaaaatcttgctgtgttaaattacctgtacggattttaacctgatccactcgagaaagtgaagctaacatacgcatcaaaatctgttcagccggcatctccaagctaaaaaccaaaaccggtttttccgataacatcgcagcattctcacataaattcatagcaaatgttgtcttacccatcgaaggacgagctgcaacaataattaaatcggatttctgtaatccagatgttttttgatccaatgcagtaaaaccggttgaaacaccggtcacaccgttatttgttggtgtagccgccagattttcaattttatcaatagtgttaaaaagaagatttattacattttgcggtccttcattagctgatgttcgtttttccgcaatagaaaatatatcacgctccgcattatccaaaatgtcttttattgcttgcccatttggtttatacgcattttttacaatattatttcccactgaaattaactcacgtaaaattgctttttcacgcacaatttcagcataagtcaaaatattggccgcactcggcgtattgttggacaactctgctaaataagcaaaaccaccgacctcttcactttttccttttgcctttaacacctcatcaagaactaataaatcaacaggggtattttgtgcaaataataatgctatttcttgaaaaataatccgatgctcaaaagtataaaaatcttcggcaatgatctgatccgctacgctatcccaataacgattatctaatagaatcccacctaaaacagcttgctccgcttcaatggaatgaggaggaatgagggtttgctcaaattttttatctttgatccgtgcagattgatttgaaccggtagttgctttagtcattaaaagaaaaattacctaattagaaattgaaaactgtgctatatgatataccaaatctaagcgagaattaagagagagggaaaaattaatcaaaacaatataagtgatgaaaagcaaccgcaccttaaagtgcggttatttttgagaaattttacttcttacgtcgttcaattaatgcctcagacaattgttgtaatacgatttctgtatctgaccaaccaatacaagcatcggtaatactttgtccataggtaagtgcttttgcttcaactaaatcttgacgaccttcaactaaatggctttcaaccatgacaccaaaaatttgttttgaaccattagcaatttgagtacagacatcagtgcaaacatctaactgttttttaaattgtttactactattcgcatgactaaaatccaccataacatgcggaatgcgaccggttttttctatatccgcacaaactgtccgaacatcttccgcactataattaggacctttctcacctccacgcaaaataatatgacaatcctcatttccttttgtagacacaattgctgaatgaccgaattttgtgacagatagaaaataatgtggtgcttctgccgtacctattgcatcaagagcaatgcgaactccaccgttagttccattcttaaagcccaccgcacatgacaaaccggatgccaattcacgatgaacttgcgattccgttgttcttgctccaatagccccccaactcataaagtccgcaaggtattgcggtgaaatcatatctaaaaattcaccggcagtaggcatttccatatcgttaatatcagataataatttacgtgcaatacgcaaaccatcatttaaagcatagctaccatctaaatgaggatcattcactaatcctttccaacccacagttgtacgtggtttttcaaaatacacacgcattataatttccaacgtatcatgatattttatacgcatttctttaatgcgtttagcatattccaacgcagaagcaggatcatgaatagaacaaggtccaataataacgagtaaacgatcatctttttgatgaataatgttatgtgctgccaagcgggctttttttactgttttaatggctacatcacttgcaggaaatttttctaataatgcaatagggggcaaaacttgctcaacttttgcaattctggtgtcatcatttgcaatacgaatattatttttattcttagccatatactactctctcttactacataaaatttacaatcatagaattaacaatttatatttaatggtattaaacgtaacatttatttttgtactagtaaactaatttttcctagtacgcacttaagacttgtgcaggttgtaatttagccgctcggcttgctggatataaacttgccaataaactcaacatcaaagcgaccactagtaccataagtacatcttgccaatgtaattcgctcggtaaaaaatcaataaaataaattccatctgataataactttttatccagtaaaaattcaataaattgaatcagatcggttaaatttaaactcagtattacccccaatgctattccaactaaacagcctttcatacctgattgcaacccgtaccaaacaaaaatttgtttaataaaacgattattagcccccaatgtacgcataatagcaatatcagcctgtttatcttttactgccataatcaaagttgacacaatattaaaacaggcaacacctatcaccaacaccatcgcaatatacattactgttctaattaactgaatatcgttatacatataaccaaacttgccaatccaatcttgaacttgtaggcgttgcggataatcatataaatattcatacgtcatctttctaaccgcaaaaggatcttgaacttttagctcaaccccagtaatttcatcgggcgtataatccaataatacttgtgcttgcgataagctcatcaacgcatagctatgatccaattgcccatctaaacgcaaaatacctgttacttgaatgcgataacggagaggctgagataattgattatcgctattagcaaaagaaattaataacgttacccaatcattttcggatacacctaattctttcgcaatgccatagcctaaaaccaaaccgccatttttctgaaattgttgccagccatcatttaacacaaatttactcaaattactcacttgatcttgtgtaacttgttctattcccctcacttgagctactttcagttttgtgccgttttcaattaatgccgtaaattcaacaaaaggggattgtgctaaaacatttggatcctgctgtaaaagtgcggtaattttttgtcgactttcaatcttgacatttccttgctcttgatacgatataatttcactatgtggaacaacagataaaatacgctgattaagttctcgctcaaaaccgttcatcgcacttaatcctacaatcaacactgccacacctaatgcaattccaatagttgaaaataaagcaattaatgataccaacttatttttagaacgactgtattgataacgccagctaataaaaaatggagtattcatgagttactttccctcaagataccgtcttgcatcactaaacggcgacccaacttttccgctaattgcaaatcatgagttactaataaaaatgcaattttttgttcctgattaagtttttggataagttcaaaaatactttctgttgtcttatgatccaaatttcccgtaggttcatcagccaacacgagttttggattattcaccaacgatctagcaattgcaacacgttgacgctctccgccagaaagtgcggacggtttatgcaaaattctcttagccaatcccaccgcacttagtatattctcagctcgatctttcgcctctgttttatttttgtgactaattaacatcggcatcatcacattttcaagtgcggtaaaatccgccattaaatgatgaaattgatacacaaatcctaaatactgattacgcagtttagctaattcgtcctgtgttgccctttgtagtgattgcccatgaataaaaacttcaccgcttgttggctgatctaatccgcctaacatatgtaaaagagtacttttgccggatccggaacttcctacaatagcaattaattctccttcctgcatggaaaaagacacctcttttaagacttgagtttgaagacttccttcctgataatgctttgtaatattttgacagattaataatctattcatcgtttgctccagttctcttattattcataacgtaatgcttgtgccggctcaattttactcgctcggtaagctggataaattgttgatattaaagataatgttaacgagaaaaataaaattaacgcaatttgataaacgttaatttctgtcggtaaaaaaataccctgaggattaatccactgaataatcttcgctaaattcattgctacaacaacccctaaaccgccacctaacacagcaccgcttgcccctacaaaaaaaccttgcaaaataaaaatattacgcacttgtccttttctcaatccctgtgtttgtaaaatagcaatttcaccttgtttatccaccaccatcaaacttaatgaagtaacaatattagaaacagccaccacaataattaaactaattagcaagctcatcatattcttttccatgcgaactgcttggaaaaactcccctttttgactacgccaatctacaattttccattgctcagtagggaaaaacttaggcaattcactaatgaaaaaaggatcttgcaaaaataagcgataaccttgaacttgttcaggtttaatccgcattaagcgtccaatatccgctaaattggcaaaaactgcatagcttgcctgttcagaaaaggaagagtaaatatcactgatggtaaataaacgttgtaccggaactcgaccaaagggagtatattggctattttccgtcaccatcactcgaactttatcaccaatctgtacgtttaatttttgtgccaatttccaaccgataattaatttaaactcaccgattggaagaagttgcgaaaaatgattttctgaaaactcactcaataaaggatcatcagaaaatttttgcaccccaagaatttgcccagcactgacaccttgtgcagtttgaaacacgacagaagttgtattaatcggcacaactttttgcacaaaatcgggcatgtccggttgcgaggtggtcaaatatatagaattatttttaggcattaaaatactgtgcggaatattggaaagaacctgttgtttttgatatttttccaagccgttcatcacagacaaaacaataattaacgccataacacctaaaataataccaacggtagcaagcgtcgtaactaattgcccgaagtgatccgcacttttagcccgccaatagcgtaatgcaataaaaagagaaattggaaaggtcatcttataatctataaaattacaaatctatgaattcacgttgcgactacatcaagaaaataaaaacaataaaattggatttattaaaccagtgttttctttgttactgaaaattaatctaacaaacccaatttagtcatttttactgagtaaataaaatcagcttaactaattatttacctgttttgacaaactctccaatattttgtgcaactttgttcaccaaagtggtcaccgcactatctgatgcccatgcaatatgtggagtaacaatcaagtttggtaaacgagtagctgcctgaataagcggattctctttctcaggcggttctttaaccagtacatcaatagccgctgcggcaatcactttattttccaatgcttcaaccagtgcctgttcatcaactaaagggcctcgtccggtattaattaagtaagccgtcggtttcattaactttaacgtttctgcattaatcaaattttgtgtttgctccgttaaaggacaatgcaaagtcacaatatccgcttgctttaaaacctgttcaaaaggtaaatatcccgaacgaatttctgttgcaccacgatgttcagcgtaaatcacattcataccaagtgcggtcgctaatcgaccaatttccgaacctaaacagcctttacctatcacgcctaaagttgatcctttaacatcggtaatcggataatcaaaatagcaaaattgtttacagtctgcccattttgcacttagctgatctctgtaccaattcattaaactatgttttaaggcaaaaattaaacctaagacatgctcaggtacggttaccgaagaatagccggttacattttttactgtaatacccaattctttagctgctattaaatcaacattattcgttcccgttgccgtaatagcgattaattttaacttaggtaattgcaacatcacctcacgactgaaaataaccttactggtaataacaatatcagcctcttttgcacgatctatcaactgatcagcatcggtatattcatattcaatccattgatgctcaaaacttgggcgaggaatagtaatatgttttggaattgccgtactgtctaaaaatacaatttgcatcattttctccttagttaattggaataggccgtgtcaatataccaaagtaataaacataaatatagaaaaaatccgtattcactaaaaatacggatttttcattatgctcatttaatttgacgtatctatttcctcaaaagatttaactagatcatcaatagctttcatttgtgcaacaaaaggttcaagttttgataaaggtaatgccgatggtccatcacactttgcttggtttggattaggatgagattctaagaataatccggctaatccaatcgccataccggaacgagccaattcggttacctgatcacgacgaccaccggaagctgccccaaaaggatcacgacattgtaaagaatgagttacgtcaaaaataacagggcaaccttgtgacacttttttcataatattgaaaccgagcatgtccactactaagttgtcataaccaaaattagtacctcgatcacacaaaatcaccttattatttccacattctgcgattttttccacaatattgcctatttgacctgggcttaaaaattgtggttttttcacattaatcaccgcacctgtacgagccatcgcttcaactaaatcagtttgacgagctaaaaaagccggtagttgaataatatcaacgacttccgctacaggtcggcattgataaatttcatgtacatcagtaatcacttttacaccaaaagtctcttttaattcttggaaaatttttaatccttcttccattccaggaccacgataagaatgaatagaagatcgattagctttgtcaaatgaggctttaaatatatagggtacgcctaatttttgcgtaacttctacatatttttcacaaacttgcatcgccatatcacgactttccaacacattcataccaccgaataaaacaaaaggcttattattgccgatttcaatattgcctaactgaataacttgattttgcataatcatttccttactaatgaatagattcaatttctaattgtaaatattccaattgaggtaataataaaagtgcggtcggatcttccggacatttttctaaaaaatattcaaagtcattcaatgccgcttgcatacaccccatttgagttaataccaccccacgatcacgaatttcataaggatcatcaggatttctggacaagagcatatcaatatattgatatgcctcattatttctaaattcacgaattaacgcatgctttgctaattgacaaaaccgattcgttaattcttgcacatctgcaacttctaatatctccaagcttaattcagtaccaaaaccaaatgctccttcatataacttttttagctgagaatatgtcatatattgaccattccaaggatcaataaaggcgacctcttcatcaacatcagcacgcaaaattaattgcgtaggaaaattgaccggataaatgggcaaattcaaactttcagccaagtataaaactattgctcccagtgttaccggcattcctcttcgttgcgttaacacttgatccaaatataagttctccaacgcaaaataccgttcgggatcacaaaaaaatccccattctccatacatcaactgcaataaatgatgaatttttcttttagtttcccaattagaatcaatttttttacgagcttcacgaaccaaaccgccaatcatgcctcgaatacgccgtatttctttactactattgtcatgcgtaataagataaaaagaggtcatttcatcatataatgctttatgataatacttcattttttcctcttaattgagctaatgttattcgctcattaccgccataatcgttaattgtttcaacttgtttccacagtttctcggcaaaaaaagaccgcactttttgcccttgctgccagccatgctctactaataaaaaaccttgtttttttaaataattaggagcttgctcaataatatattgtaaatcggcatatccttttttttctgccaccaacgccgtcaaaggctcaaaacgtacatcaccctgatttaaatgctgatcttccgcatcaatataagggggattactgacaattaaatcaaattgtccagttacttgctcaaaccaattactttgcaaaaactgtacttcggtcaaatgattacgcactgcattagtttttgctaatttaacagcgtcggcaataacatccagaccaaatatctcaaaatgttgaccgctctttttcagttcatcagccaacgccaaagctatagcacctgtccctgttcctaaatctaaaatacgaatgggggattgagtaaagtcttttgatttcttaagcaattgaatgcaaaccagtgcttgttcaaccaaaatctcagtatctggacgtggaattaaagtatagggagccacctgtaaatttaatgtccaaaattccgtttcacccagcacatacgccattggttcacctttagcacggcgaaccaataattctgtgagttgtttcaattcatcctctgtcaataaggtttctgaaaaagctaaaatcgctgattttgaacgtttagtgacggtctgcaataacaaatttgcatcaactttagcatctaagaaaggatctttagcaacattctcaaataaacgtttttcggcaagttccagccattgttgataattcatttctttagtgaaacttaagttttcttcacaacgatagtcgacataactatatccactaacgaacgtctttcctcatttgcaaaagcaacaattgcactaactgaagttaagatacctgttaatgcaaaaagctgttcaataaattcacgcaatacataacgaccaaatgttaaggggtgatttgttctatagtctatcacttgtaaatttagccatttctttgctaatgtttgcttagcgttatacatgaggaataattgatatccgatatagaggaaaataaaaatgagacctgcaatctggttcaagacaatagctccaaacaaaatagccacatagaacaataatgcatttatgagggaagccaaccaacgcttaaatcgactggcataaacaatatctgatacgttattggaatttgcttgtaatttatgatcttcttcaacaataaatttacgattttcatcattagaattgtttttttcatttaatttttcaacaatcatcgtatctccttctcataatcttaagaggaattttctcttcgtcagaatagattaatgttgttcggacaacattgccaactgatctgcttgatattccgtaataattggttgaattagctcgtcaatcttgccattcatcacttcatcaaggcgatataccgttaaattgatacgatgatccgttacacgaccttgcgggtaattgtaagtacgaattttatctgatcgatcgcctgaacctaataaattacgacgagtatccgcttgggcttgagcttgacgttcctgttcagcttgtgcaatacgagaagctaaaacggaaagtgccttcgccttatttttatgttgtgaacgctcatcttgacattccactacaatacccgtcggaatatgcgtaatacgtaccgcagaatccgttgtattaacatgctgaccacctgctcccgaagagcggtaggtatcaatacgcaaatccgacggattaatctccggcatttcattttccggtaattcaggcataacagctacggtacacgcagacgtatgaattctgccctgagattctgtttttggtacacgttgcacacgatgcccgccggactcaaacttcagttgaccatacacgccttcgccattcactttgacaataatttctttatatccgccttgctcactttcatttgcattcaatacttccacacgccaacgtttactttctgcataacgactgtacatgcgaaataaatcaccggcaaaaataccagcttcatcaccgccggttccagcacgaatttctaaataagcattgtattcatcatttggatctttaggtaataacaggatttgtaattgttgctccgcattttcaatttcagcttttgactcttctatttccaattcagccatttctttcatatcaggatcatcaagcaatagttgtgtttcttcaatatttttattcaaccaattccaacgtgcgaaacattttacaacatcttctaattgagcatattcttttgaataagcacggaatttatcttgatcgttaatgacagacgactccccaagcaacgcttcaagttcttcatgtctctcttttaagctctctaatttactaataatactggctttcattctctaaccttacaaaataataatgtaaatttaaatttcaaaacttaatatcaccgaaccattggtatattttatcgtgtattcgagtaccataaaaatcaacaatatttctatcatatttgaaaacagcggtggaaaataaggtaatcactctttcaaaattcacatcaagcaattcaaatagttcactcggcacaacatcttgatatacaaatacattctcaaaatacttttgataatctgttgtttctctagggtgtggttttatcactagcaaacgctcgtcataattttttatgatatgttgataaatggctattttctcttgctctgatattacacgatcttccgataaacactgcgtaaataatatatatttcttcatttttaacgatataagtgaatctaaattaaaagcaaagaaatccaatatgttatgttgttcttgagctgttcttgttttccataaatgctctaatgaaatcagttcaactttatgcctaatgtcacttggtacattttctaaagaggtcaaataaattttctttaccgtcttatgaaaaccaaaaacaggaatatcccttgttaaattaatttcatatcttttaggactaaaattcgctatgccatcctcgattaaataaaaatcaaaatatttaagaaaataatctgtccaacctaaatgatcagcaccataaacaggaatacggtcaatcttaaatcgataaaaataaagtttataatagagacgccaaaattttgttattttctttttaatggcaacatagtgcttgattttatactttttatgtaattcaaaatcttcattaaaaacaaataacacttcatctaaatgatatttatttaacatcataaaaatcaacaacattcttaaactactgacaataacaattgctttgatttttatattatacttcatgatattcaactatttttgctctaaatcttagattattacccaactccgaaaacagaaaattcaattcgaggctgccttagaattacctaaaacagcctctatataataaccataatagcagagctacattacagacacatttaaagtggagccaccaacaatacgaactcgagctcccggcactaaagttgcatcatacttttgcacaacaacaatttcttgtccattgtcttttctgataacaagttccaacgcattaatctgacttgctttttcttctactttactaccaattaccgctccggcaatagcaccaactgctgcagcgactgcctgtccggtaccaccgcctatactagatcccactattccacctaaagcaccaccaccaacagtcccaatcacaccttggttatcgccttgaattttaaccggacggattgattcgatgataccataactgattgaacgagctgatttagcttgtgtgccactatatacattaccactgtatatatcttcattggcacacccagctaatcccaaactaagtaaaatagctaatgataaagtcatttttttcatagtagttaacctctcttttttgattaatttttagatgttctagaaagccaagaacttgatcttttacgagaaatatttgttactgttataccatcgtcattgtgagagacttctacacaagagcctacaactaaatgagaatcgtaagaatgacttaatacgatctccttaattcctccctcttgctgtttgcaatcatttttacgaatagttaattttaaattatttcctttttgagtagcgaacaaaatttcgcccctatacacattatcattttttgtagatgagcaagctgctaatcctaaaaaacctaataataaagtgaatgctaatgttacttttttcatcgaatctaaccctcaattatctttttgatatgatacgggtgaacttttatgcaagtatgattttctagttgattaacaaaactcactgcaatagacgggttaggtaattgctcgccatccgccttaggttcacttactttaactttcaaattagccaattcgtcccataaaaattgttgtcttatacgtgtaacccattcatcaacagtttcattcacttcaaatggaattataacttcaatatgctcccagttttccactggatacactttatctttagggaacggtaattcaataatatcaataaactgatccgaaaaacgtatcggattatcaagttgaattaaataaataactctcccgtttacaatattaccgctcagaattgtaccgcactttaacagcaaagtcagccaatcctccgcagatttacgtttatttactctcaaggcaatatggtcaatttcaacacgatctaaccgtaattgcatggaatgggctaattcaataatttttctttcaaattgttcaaactcatctaatgagatattagattgccgaaacaaagaatgattttggttaaaaatctgcattttttattgctttatcttttctgaataaggaaagagcggtatcataacgcattattttcacaaatcaattattaggtatatcagtgaatattcagtctattttatctaacaaaatcaaacaagcgatgcgtcaagccggtgcagatgaacaatgtgatgctttagtgaaaccatccagtaaacctcagtttggcgattatcaagctaatggaattatggcaacagctaaaaaactgggtttaaatccccgtgattttgctcaaaaagtactcgatctcattgatttaaaaaatattgccgaaaaaatggaaattgcaggccccggatttattaatatcttcttagataaaaattggttggcagaaaatattcaagttaccctacaggataagaaattaggcgttacagtcgaagaaattcaaaccatcgttgtagattattcctcaccgaatgtagcaaaagaaatgcacgttggacatttgcgttcaaccattattggcgatgctgtagttcgtacattggaatttttagggcataacgttattcgagcgaaccatgttggtgactggggtacacaattcggtatgcttattgcctatttggaaaaaatggaaaatgaacatgcttcaacaatggaactggcagatttggaagccttctatcgtgctgctaaagaacattatgataatgatgaaacctttgcagaaaaagcacgtaattacgtggtaaagctacaaaatggtgatgcttattgtcgcacaatgtggaagaaacttgttgatattactatgcaacaaaatcaacgtaattatgatcgcttgaatgtgaccttaacccaaaatgatgtaatgggggaaagtctgtataatccaatgctacctgaaatagttgcagatctaaaagcacaaggtttagccgttgaagatgaaggtgcacaagttgtttacctcgaagaatttaaaaataaagagggtgatccgatgggggttatcgtgcagaaaaaagatggcggtttcctctacacaacaacagatattgcagcggctaaatatcgttatcatacattaaaagcagatcgtactttggtgttttccgacacacgtcaaagccaacatatgcaacaagcatggttgattactagaaaagcaggttatgtgccggacagtttccagctggaacataaaaatttcggtatgatgttaggtaaagacggaaaaccgtttaaaactcgctccggtggaacggttaaactgacagatttattagatgaagcgattgaacgtgcggataaattaatttcagaaaaaagtaccgcactttcaagcaaagaaaaagcagctgtgatagaggctgtgggtatcggttcagtcaaatatgcggatctttctaaaaatcggacaaccgactatgtatttgattgggatatcatgttaagttttgaaggaaataccgcaccttatatgcaatatgcttatactcgtattcgttctattttcaacaaaaccgatattagcgaagaacaacttcaccctgcaaagatccagctcacagatgaaaaagagcgtttacttgcaattaaattgctacaatttgaagaaacagtacaaattgtaggcaaagaaggaacgccgcatattctatgtgcctacttgtatgagttagccggtttattctctagtttctacgagcattgtcctatcttgaataatgatgatgaaaacgtgaaattaagccgtttaaaactcgccttactcaccgaaaaaaccttaaaacaaggtttggatttactcggtataaaaacagtggaaaaaatgtagttcagatatttccattattggttcgtataaaaaaggcaacatccgttgccttttctgtaggttattaatttactcatggtgtcaacaaagttcttaaaactttaccaatatcagccaaacttcttaccgttttcacgccggctttttccaaagcgacaattttttcctctgccgttccttttccgccactaataattgctcctgcatgtcccattcgttttcctttcggagcggttactccggcaatataagccacaacaggtttagttacatgtttatggataaaatcggctgcttcttcctccgcacttccaccaatttcaccaatcatcactatcgcatcagtttcaggatctgcttggaataatttcaaaatatcaataaaactggaaccggggataggatctcctccaatccctacacaagtggattgtccaaacccctcatccgttgtttgttttactgcctcataagttaacgtgccggaacgagaaacaattccgatacgcccttttttatgaatatttcctggcataatccccattttgcattcctctggtgtaataacaccgggacaatttggaccaatcatcacgacatcactttgctgtaatttttttttcacctccaacatatccaacgttggaataccttctgtgatgcaaacaataaacttaatgcccccatcaattgcttctaaaatagcatctttacaaaaaggtgccggaacataaatcatggttgcggtagcaccagttttctccactgcctcacgaacagtattaaaaacaggcaatcctaaatgcaacgaaccactttttcctggggaaacccctccaactaattgagtgccataagctaaggcttgttcacaatgaaacgtgccttgtttaccagtaaaaccttgacaaatcactttggtatttttgttaattaaaattgccattattcactctcctttgctgcattaactgcttgttccgctgcttcagttaagctgtttacagcaattaaattcaagttactttgtgctaaaatttcacgtcctaagtccgcatttgttccttccaaacgcacaacaactggaacactcacaccaatttcattgattgcggaaacaattcctttagcaattaaatcacaacgcacaataccgccaaaaatattcactaatacggctttaaccgcactgtccgttaaaataattttgaatgcttccataacacgttcttttgttgctccaccaccgacatcaaggaaatttgctggtcgtccgccatgtaatttaataatatccatcgttcccatggctaaaccggcaccattgaccatacaaccaatattcccatttaacgcaacgtaatttaaattccacttttcagcctcagcctcacgaggatcttcttgcgttaaatcacgcatagaaaacaagtcaggatgacgatacaacgcattatcatcaaccacaacttttgcgtctaagcaaaataattcatcgttttttaaaataaccaatgggttgatttccagtagggataaatctttttcaacaaataatttggcaagttggcaaaaaatttggctgaattgctgaatttgtttccctgataatcctaatttaaatgccaattctcgcccttgatatggcatcgctccaaccaaaggatcgatagttaccctatgcaataagtgcggtgttttttctgctacttcttctatatccataccgccttcacttgatgccataaagacaatacgttgagagctacggtcaataattgcactcaagtacaattctttttgaatttccgcacagggttcaagataaatttgatgaatcggttgtccctgttcatttgtttgaacggtaactaaacgctgtcctaaaaacttagtaaaaaacgaccgcacttcttgtgctgatttaaccacttttactccaccagctttaccacgtccaccggcatggatttgacattttgcaatccattgagaacctgataatttctcaatcgcacttaacgcctgttcaacattttcacaaacataacctttagttacaggtaaaccataatctgcaaaaagttttttactctgatactcatgtaaattcatatcgtccccttattgatacgtttcaataccgcacttttagattatcggtacttctaaatttccagtagcaagcgagtcggatcttccagcaagtccttcactgtcaccaagaaaccgacgctttcacgtccatcgattaaacggtgatcatagcttagtgccaaatacatcattgggcgaataaccacttcaccattaaccgcaacgggacgatctttaatcgcatgcatacccaaaatcgcactttgtggcggatttataataggtgttgacattaaagaaccaaaaacgccaccgttagtaatagtaaaattcccccccgttaaatcttcaacggtcaattttccatcacgacctttttccgccaacaatttaatttctttttcaatatctgccatacttaatttatcgcaattacgtacaaccggcgttaccaaaccacgaggtgtggaaacagcaatactaatatcaaaataattgtggtaaacaatatcatcaccatcaatagatgcgttaatctccggatagcgttttagtgcttcaaccaccgctttgatataaaaagacataaatcctaagcgtgcaccatgttgtttctcaaatttttctgcataacgcttgcgtaaattcataatcggctgcatatccacttcattaaatgttgtcagcattgcagtagtattttttgcttccagtaaacgctctgcgatacgcttacgtaaacgtgtcattggtacacgtttttcattgcgatgatcaattttcaacccagttgcaatagactgagatgcttgtgccgtttctgtttgttgtgctttttgcttaaccactaacgctatatcttcacgagtaattcgaccacctacacctgtacctttaatttcatcagcatttaattcatgctccgctaacaaacgacgaacagccggactcagtacatcgctacttgcatcagtattcaaattagccgaatgacgatctgccggtgttttttccacattctgtacagttgattttgtaacttctccaatacctgccgaagcggatactttacccaacaattgtttactcacgacagttgaaccttccggttgtaaaatagtttcaagcaccccatcactaagtgcgggaatttccaacacaattttatcagtttcaatttccactaaaacttcatcacattttaccgcatcacccacgttcttatgccacgttacaacggttgcatccgccacagattcagggagatccggagtaataatatcgaaattgctcatattttttcctcctattcatatttcgcttaaaattagatatatatccgttaattattgaaaatttttccaatactttaacctagcaaaattacgctaatgcctcagttaccaaagctcgttgttgctcattatgtagagataaatagcccactgccggtgaagctgaagctggacgaccaacataacgcaacttaccatgtgggggtaatgatgtccaaaaattatgctgacagcaataccaagcaccttggtttaacggttcttcctgacaccaaacataatcagttacgtgagagtaaggagctaaaacctctttcatttcttcatgaggatacggataaagttgctcaatacgaataattgccacatctgtctgattatttgctcgacgttgttccaataaatcataataaacttttccggaacacatcacgacacgacgaactttttgaggatcaatagcatcaatttccgcaatcacattttgatattttccattcactaactcctccatagtagataccacaagcggacgacgtaacaatgattttggtgtaataacaattaatggacgacgtactttacgcaacatttgacgacgtaataaatgataaatttgtgccggagtagaaggtacacatacttgcatgttttgctgtgcacagagttgcaaataacgctccaagcgagcagaagaatgttctggaccttgcccttcatatccatgtggcaacaacatcactaaaccacacatacgtccccatttttgctcgccggaactaataaattgatcgatcacaacttgtgcaacattcgcaaaatcaccaaattgtgcctcccaaatagttaatgtccgtggtgccgctgttgcgtaaccatattcataagctaaaacagcttcttctgataatacagaatcccaaacttcaaaacgcccttgttgagcatgtaattgagttaatggaatatacaacgtcgcatctttttgattgtgtaatactgaatggcgatgaaagaaagtaccacgtcccacatcctcaccagataaacgaacattatatccctcatcaagcaaggtcgcataagccattgtttcagccataccccaatcaaataatttatcgccttgtgccattgataaacgatcatcgtaaagttttttcactcgaggatgtaatgaatgcgaacttggataatcacatactttcttagctaatccgacaaaacgctcagaatcaaaggaaccatcatactcagtccattcttgcgttaaatacttagtccaatctttcgtttcaatatccgcttcacgccattccggtacaacacaacctccattatccaaagcatctcgatatttatttgctaattcaattgcatatgcttcatcaatgataccttcagtaactagacggttcgtataaactttcggaggtgttgggtgcttacggatacgttcatacataagcggttgagtaacagcaggttcatctgcttcattatgcccatgtcgacgatatgacaccaaatcaataaaaatatcacgcttaaattttgctctaaattcaaccgccattcgtgcagcataagcaacagcttccggatcatcaccatttacatggataaccggtgcctcaatcatcttcgctatatcagtacaatattctgttgaacgtgtatcctgtagatttgaagtggtaaaaccaatttgattattaatcaccacacggattgtcccaccaactgtatagcctctcacttctgacatattcagtgtctcttgaacaatgccctgccctgcaaccgcactatctccatgcaccgtaattggtaacacttgagaacgttcaacgtcctgaatacgattttgtcttgctcgcacagaacctaagacgacaggatttacaatttctaagtgggaaggattaaatgccaacgctaaatgtacaatgccatcgtcagtcataaaatcagatgaaaatccttgatggtatttaacatcccccgtcccactgccactatgcttaccggcaaactcatcgaataattctgaaggctttttacccaacacattaaccaatagattcaagcgacctctatgtgccatgcccatcacaatttctttcacaccatttctgctactatgacgaatcatttctttcattaacagtataaaagcatcgctaccttctaaagaaaagcgtttcgctccagggaatttcgcccctaaataacgctctaatccatctgctgcaattaattcttctaaaaatttcagttgttcttctcgggtgaacagcggtttatctaataacctctcaactttgcgttgcaaccacgtacgagcgtcaagatcgttaacgtgcataaattctaaaccaatcgtactgcaataagtctttttcaacgaattggctaaatcacgtaacgaaatttgttccttgttataaacataaccgccaatatcaaaaacttcatctaaatcattatcagaaaaaccataaaacttataatcaagcgttggtgcctccatacgttgccacatttttaacggatccaaatccgcatgtagatgccctcggttacgatgcccatttatccatttaagcacattaaccaatctcgcactaacattaggatctatcacccccactccattttgagaagtatcacgtgctaaacgtttaaaataatcacggacttttgaatgaggctgctcaagtgcgttctgttttggaagagaattgaaaacttgttgccaactttcgtcaacagcttgagggttatcaagataatcttcataaagatcctcgacataagactggttcgcaccacctaaagcactggatgccaaccattcactgatagggctattttttttcattatgaccacctaacttgattattgatagcaatttacagtgtaattttttccattatacatagatttagccataaataatctatttatttgataagctatatcaatttcagctggaaattaaaaatcaaattacctatctaagcaataaaaaagttaaaaagttgttaataattttttatttttttgatctacatctcatttttaaacatccaacaccttatttgtaaaaataatgtaaaatttatgcagacagtaacaaaattaaacgttatattgaaaacatacacaaatattcaacatcttactttctttataaacttttaaactctcaagggggaatgtcttatgtctaaattaacagcaaaacttacacttagtgacggacgtgaatttgatttaaatgttcaacaaggaacgcttggatacgatgctgttgacgttcaaccgttagttaaaaataaattatttacttttgaccccggatttatgtcaactgcatcttgcgtttccgaaatcacctatatagatggtgataacggcatactgttacatcgtggttatcctattgcggatcttgctaaaaatgcggattatttagaagttgctcatctactgttatttggagaacgcccgaataaagaagaatatgccaactttataaaattggtcaaaaatcatactttagtacatgagcaaatttctcgcttcttccatggattccgtagagactctcaccctatggcgattatgtgcggggtaagcggtgccttagcagctttctatcatgattccttggatattaatgatattgaacaccgagaattaacagcaattcgtttattagcgaaaatgccaacgcttgcggcgatgtgttataaatattctattggacaaccttttatgttcccattaaacaaactttcttatgcaggaaattttttatatatgatgttcgcaacgccttgtgaaccttatgaagttaaccctgtattagaaaaagcgatggatagaattttcattttgcatgcagatcatgaacaaaatgcctcaacatctacagtgcgtaccgctgcttcgtccggagcaaacccttttgcttgtatcgctgcaggaattgcctctctttggggaccggctcatgggggagcaaatgaagcctgcatcaatatgctagaagaaatcggttctgttgatcgtattcctgaatacattgcacgagcaaaagataaaaacgatcctttcagattaatgggattcggacatcgagtttataaaaattacgatcctcgagctaaagtgatgcgtcaaacttgccatgaagtattaaaagaattaaacattcagacaccgctctttgacgttgctatggaattagaacgtattgcgttaaatgatccttactttatcgatcataaactgtatccaaatgtcgatttttattctggaattatcttaaaagcaataggtattccgacatcaatgtttactgttattttcgctttagctagaacagtaggttggattgctcattggaaagaaatgtttaaacctgggaatatgaagattgtacgccctcgtcaattatacaaaggacatacagaacgtaactttgatgccattgaaaaataatttctgtcagagttaaagtgaagctcgtctctttttgaatggcgagcttgattttttgtaccttattctatttttatcaaaatttacaataaatcatggtaaaattagactaattaatcataatcgggaatttttctatggcatacactaccttttcacaaactaaaaataatcaattattagaacctatgttttttggtcaaaacgtcaatgttgcccgttatgaccaacaaaaatatgaaacctttgagaaattaattgaaaagcaactctctttcttctggcgaccggaagaagtcgatgtatcacaagaccgcattgattatcaagcactacctgaacatgagaaacacatctttattagtaatctaaaatatcagacattattagattctatccaaggtcgtagccccaatgttgccttactgccattagtttccattccggaattggaaacatggatcgaaacttggacattctcagaaacgattcattcccgttcttatacacatattattcgtaatatcgtaaatgatccgtcaatcgtttttgacgatattgtcacaaacgaagaaattatcaaacgtgcaagagatatttcttcttactatgatgatctaatccgtgacagtcaactttacggattatatggcgagggtacttatacagtggatggtaaagcctgtaaagtcactttacgcaacttaaaacgccaactttatctctgtttaatgagtgtaaatgcgttagaagcaatccgcttttatgtttcctttgcttgctctttcgcttttgctgaacgcaaattaatggaaggtaatgcaaaaatcattaaatttattgcccgtgatgaagcactgcatttgacaggcactcagcatatcctcaacatcatggcggcgggacaagatgatcctgaaatggctgaaatcgctgaagaatgtaaacaagaggcttatgagttattcgttgcagcggcggaacaagaaaaggaatgggctgattatctctttaaagatggctcaatgatcggattaaataaagatattcttgtgcaatatgtggaatatatcacaaacattcgtatgcaagctgtaggcttgccattgcccttccaagcacgttcaaacccaattccttggataaacgcttggttagtatcggataatgttcaagttgcaccacaagaagttgaagtcagttcttatcttgtcggacaaattgatgccaaagtagatacaaatgacttcggcgatttcgatctataaaacacctataaaatcaaccgcactttgacctaggttaaaagtgcggttgatttttactaaaaatgatgaagatttatcaagtttatatcagcaattaccggcaaacgcttacccatgccaacgaaatgcctttattggaaaaattagaaaaaaacggcattatacatgaatatcaatgtcgctcaggttattgtggttcatgtcgggtaaaactacaaaaaggcaaagtgtcttataaagaacagccccttgcctttcttaatcaaaatgaaatattactttgttgttgccaattggaagatgatatagaaatcgaactctaatctatacacgagcaaaaatgcgacttccaattcacttatctcttaaaaaatatttactggttagcattttccttcgttgttacaaataatagccaatatcctactacagccgatacactagaaccaaacaagatacctaatcgtgcataagcggttaagtgtccatctcccccaccaaaagcaagactagctaaaaacatcgacatagtaaaccctataccacaaagtaccgaaactgcaaatatctgtttaaaattaataccttcaggtagttttgctatatgcagtttcactgataagtagctaaataaaaacaccccaatcggcttacctaacaataaccccaacgtaacacccagtgttaatggtgaagttaatgcttccatacccaaaccggacaaagaaataccggcattacaaaaagcaaagagcggtaaaattaaaaatgagctccaaggtgcaatagcatgttccatttcaaccaaaggttcgctgttatttttacctttcagcggtacacaaaaacctataatgacaccagctaatgtcgcatgcacacctgatttcaatacagatacccaaaggataatcccaacgacaacataagcgattaaatttgatactttgaaacgatttaacaaaattaatccaacaatagcaatacttgctaaaatcaacgcttttgtacttaaatcatgtgagaaaaataaagcaatcacaataattgcacctaaatcatcaataatagccaatgctaataaaaatacttttaaagcaagaggtactcgagtacctagcaacactaatacaccaatagcaaaagcaatatcggtcgccattggaatggcccaaccgccgtgataatcaggaacaccttgatttacaagccaatacactaaagccggtacaatcattccgccacaagccgcaattgccggaaaaatagccttttgatagctggaaatcgcaccaatcaacatctcacgtttcacttccaagccgacaagaacaaagaaaatcgccataaatccgtcatttacccacattaataacggtttattaagttcaacgatagatccgaattgaataatcaccggagcattcagaaaactaaagtaatgatctcttaacggagaattggcaaatatcaccgcccctacagaaaaaaccaataacaggattcctccggcggcctccatttgtaaaaattgacgaatacattcccgaattttttcagtcattattttcattattacttcctttgcataactaaaaacgcatataacaagtttttatcacgaacttttattgagggtcaaggcaaatcaaacaattttttctattggtaaaaaaaacacaacaaagttcacaataatattcaacaaatttaacaaaactttatacaaaaacaaatttactcaacacatttaaagctgttgatacactctcaacgcatacgcatcggacattcccgcaatataatcgcaaataattcgcttacgatctgtttctgttgctttttgccaacgcattgctgtattacgaggcagtaaacgcaacggatcactgtcaaaaatttgaaacatttcagtaagcattctttgccctttatattcgacacgttgtgtatcaacatgtttaatcacatactcccatacgaagtgtttaaaaatagttaaaacttcaataacttcatcaggtaattcggcgttataacgtaataaaggctcggaaaaaccattatttattttccaacgtacatgggtaataaaataattcaccaatgcaccgatagcatttttacgctcatagtgtaattccgaaaaaagtttttgactgagcgaggatacagtctgaacaatccattcagaacgacatgctgctaatttttccaccgcactttgccactgctgaagcgttaccacaccaacaacaatcgcatcttctaaatcatgtaccgcataagcaatatcatctgcaagttccataatactgcaatccaaagatttataacgggttttcaaaacctcatcaggacgagtacgctcttttttatattgcccgaataaagtgcggtcattttccgataagggttcaagtaaccattcaaacattttcaaatcatcacgaaaaatcccttttcccggtttccacgctgaaatcttcacatatttagaatcaacattatcgacaattaccccttgatgatattgtggggaagaacgatctaaaatcgtaggatatttaacaacgcccaataacgttcgacgagttaaattcattcctgcattaggcgtataaggctcaagcttagttaataaacgaaacgtttgtgcatttccctcaaatcccccatgatgacgcatcatataattcaaggcgacttctccgccatgtccaaagggcggatgaccgatatcatgagcaaaacaaaggctttcaatgaggtcattagacggcagtattaatttaagttgtttttgcaaatctgctcgatcttccttgagctgttgagctaaataaataaaactatcaataagtttcatttgtgcaacgatactgctaccaatttgagcaacctcaagcgaatgggttaaacgagtgcggtaaaaatcattttcgcctatagcgtgaatttgtgtttttgcttgtaaacaacggaaagccgcactatgcaatattctcccacgatcacgacgaaaaggcggacgatgatctttctctctcggcggatcggcaagaaagcgttcttgccaagatgaattaatttgcaacttcatatttattcnnnnnnnnnnnnnnnnnnnnnnnnnnnnnnnnnnnnnnnnnnnnnnnnnntcaacaaaaataataaaatttataaattgatttacttcttttattcgttttgttacgttttttcggtagaataagcgaaattaccttgaataaaatgatcaatatgtggaaaaaaatcttttttattttatttttttgtgccatttctagtgtttcagccaaaaatccccgcattcttccttgttatgtagtgaaaattagtgatggcgatacatttacctgctcacttcgcaataacaaaaaggtaaaagtgcgtttacaagaaattgacgcaccggaaaaaggacagccgtttggtaaaaaagcccaacactatcttacaaagttaatttataaaaaaaacgtaaaattgcatgtgtcaagctatgaccgttatcaacgcatgctcgcaacggtttataactcacaaggaaaaaatattaatttagcgatggtaaatgcaggttttgcttgggcatatcaacaatatttaaaagatccgcagtatctacaagcacaaaaatacgcacaacgtaaacgtcttggcttatggcaagatcctcatcctgtatatccacatcaatggcgtaaacaaaaaaagcaaaagataaaaaaatatgatttttgatccaacattatttcgccagcaatttcctttttttcaccaaaaaaatggtatcacttatctagacagtgcggcgaccaccttaaaaccgcaagttctcctggacgcaacgcagcatttttatgcttctgccggctccgtacatcgaagccaatatgatgcaaaacagaccgcactttttgaacaagcgagaaagcaggtcaaaaaactgatcaacgctgaaagtgaagaaaccgttatttggacatccggcaccacacaaagcatcaacattgtcgcctacggcttaatggcacaactttccccaaacgatgaaattatcattagcgaagcggaacatcatgcaaattttgttacttggcaacaaattgctaaaaagtgcggtgcaacattaattattttaccgttgcaagataatttactcattgatcaacaaattctacaaaaatccttaaacaaaaaaacgaaattagtcgccttaaatgtgatctccaatgtaacaggaacacaacaaccgctgacacagcttatccccatcatacgagaaaaaagcagtgccttgattttattagattgtgcacaagccattaaccatcaaaccattgatcttcaaaggcttgatgcagattttatcgttttttccgcacataaaatttacggaccgacagggttgggtgtattaagtggaaaacgttctgctttagaacgattacaacccagttttttcggcggaaaaatggttgaacaggtttcaaaacaagaaactgtttttgcctctttaccttatcgcctcgaaagcggcacacccaatattgctggcgtaatcggtttcggtgcggtattaaattggctggaacaatggaatatcatacaaggggaacaatttgccgtgcaactggcggaaaaaacaaaagagcggttaaaaaattatcctcattgtcgcctatttaattcgccacacccaagcacatttgtttgctttacattcaccacaatcgccacatcggatattgcgaccctacttgcagaacaacatattgccttgcgtagtggcgaacattgtgcaaccccctatttacagcgtctaggacaaaaaagcaccctacgcctctctttcgccccttacaataaccaagaagatattgaactgttttttagtgcattggataaaagtttggagttattggcatgattgaacaaatcaaacaagcgaaaaattgggaagaacgttatcgcttaatcattttggcaggaaaaaatctccgccaaccgacagaacaacaattggctgaaatggaaatcattcaaggttgcgaagtcaaagtatggtttaaatgcttacttaaaacagaccgcacttttgaatgccacgcttatagcgaagcaagaattatgaatggcttattatggatgttattgcaagaaatgaacggcaaacaagcgactcaattggcagaatttgatttaatccaatatttcgatgaactcggcattgcccaacgtttaaccgatacaagacttaacggcttaaaacaaattgaacaaaaaataaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcacctttgctacagtaggggcgaatcacattcgccccatgacatccacccgaacggagaataaaatacataaaaaggcggatataatctgcccctccccttgtttctttaaattgccatcaatgcggatatttaagtttgaagttgtcataatttaggctcacattatagataaaaagcaaattacattacatttacatttcattataatttaaatataattagaacccactttaaatagcgtttaaatgtcattaactttggaggtttattatggattatacaaattttaatatgcgacttgataacgacttgcgtggacgggtttatcctattttggagcagtatggattgacgccaagtcaagcggtaagaatgttttttaatcagattgcacaaaccggtaaaatacccttgtcgtttgattgggcggaaaatcaaactttaaccccaaaagcagccgcacggttacgccaaactgagcaggaattcgccaatggcgaatttgaacgcttttatagcctagatgaactcaatcaagcgataaaggagagctcgcatggctaaacgcaaatttgatatggcaaaatcttttaaacgtgatttgagaaaacattacttggctttagtcggcgaagcatgggcagagatttcaaactgtcttttgaatgacttgccaattcctgaaaagtatcaagatcacccgcttaaaggcgataaatcaggctttcgagactgccatgtcaaaccggatttagtgttgatatacaaaatcgttgatgatgttgtggagttacattaccttgatagccatagcgaaatttttggctagcctaccgctctttgttgcaaaaatgtcaaaaaaaaccgctccgaagagcggttaaatttttgaggttttattatatattatatattagaagtaaacacgtaagcctgctgcgtagaaactttctctcacgtttttatcttttgtagctgctttaacacggctattagcaaattctgcataggctaataaatttttgttaaaggcatagtcagcaccgacgataaatacgttttgtactgctttttcatgttcttttaaatttaagtcagctagttttacataagaaagtacaaaaggctgttcaaattttttagccctagtaccgctagcacttcttaaactattacgttgccattgtgtataaacatttaagacatccggtaatactgcatattttgcaccgacttcaacaaagcgagcagaaccttgaaattcgtgttgaactttagattgatacactgtttgaccgtattcaataccgaaagatgccggtccgaattccacttgcgttgctaaacgccaagcttgttgttgattatcagttttagaagcaatagcaccaactttggtattttcgttacgaactgtataacccgcattggcatttaccttaacatcaccaaaattacctgtatagaacgcagacaatccgtaagtattttttaatttaacatgttttttgtctgaatcccttccttgaatatcttttttatgtgcttcaccgaagccataatcagcaccaaaacctaaagtttgcccttccgctaattggatatctgctgtacggaaagacaccactttatcaccggaagtaaccaagttgttgttaccgccaaagatataggtatgatcatttaattgcacatcatccgcagtggtattttgtttaccgaaagttactttaccgatatcgttatgttttaagcctaaccataatttagaaagtttgatgtcgttaaaagatgtatcttctttttcagcatcacctaacccgaaacgaaccgcaccgattgcttttaagccgttttgtacttcatgctccgctttaaactccacacgagagctgttattacgtaaatcggtacgttgagcatcaccgaatttacctaacattacatcaatacgaccgccaacatctactttggtaccgttttgattataaacagttgttgcgtttgctgatgccgcaactgccgctaccgctaatgctactaatgtctttttcataataaaattcctttcaaatttaaattattttactactgaattgaacctttccatatatgaaaagtccaagccaacttttaaaaaaaagcgagcctatattggcaaagaaaccgtttacagtcaactaaatttaataaaaaaatgctaaatttagtgatctaaatcacactttttgaataatttttgaacttttttgcggtacttttatttattttaatgattcgcttaatatcgtttattttccagcaaatacgctacttttgcgttcttctttctctatacagctatcaaccgtatgatcaggggttatcttgaccactaaagggtaaaaatttcattctggcgttaatcatctcaatacttttgaatacgcttgattgtttttcatttttctattttgtataatcggaactcaacgtttaattaaagggggaaatatgtacgccattgcttttgatctcgatacttctatgttaaaagagctatactccaccgagagttggcaaaatgcctatggtgatattaaaaagacgcttgaatctttaggttttgatcatcaacaaggtagcgtatattttggtaacgaggatatgactgcggttaaatgtgttttagctacacaaacactatctaagacttactcttggtttaagccgtcagtttcagatattagaatgcttagaattgaagagcttaatgatttatcccctgccttataagcgttattcttttactttataacctctaatacttgttagaggtttttttgtatctgttgaaatttacctcgctcatcgcttaaatattgacttttttcaaacaaatactatgtttttgctttattctttttcttgaactatacggctgttaaccgtataatttaggactattttaacaattaaagagggcgtatagaaatgagaacacaagtaacaaaagcaagattggaagctaaagtaaaccttgatatatacgaattattaaaacaagccgccgcaattacagggcgaaccttaaccgactttgtggtaagtgtagcttatgaagaagccaaaaaaactatttcagaacatcaaattttacgtttgacattaagcgatcaggctttactcattgacaatctcagtaaaccgtttgagcctactcagtcaatgaaaaatgcacttgatgtgtatgaagaatatctttccgttgcggggaaaaataatgataaatgaaaatttaccttatttaagcgtattgcctttagaagatttgacaattgataggaattcattttcctgctcggttgagcctttagaaacctatttttataagtatgcttctcaagatgtaaaaaaaggaattacaaagtgtttcgtgcttataaataaacaacaattcggaattatcggctattacactttatcggcactatcaatccctattaccgatatacctcaagaacgaataagtaaaggtattccatattctaacattcctgcggttttagtaggacgattggctattgatacgaatttccaaaatcaggggtatggcaaatttcttattgcagacgctatttataagataaaaaatgctacggtaggggctgcaattttagtcgttgaagcaaaaaatgatcatgctgtctcattttataagcgacttgggtttattgagtttaaaaatttgaaaaaaacacacagaaaattattttatccgctaacttgaaattttcttgaacagttgcttttttagtggtgttcagttccgacaatcggtttgattttttcccatttccgacaagatgggcaattccatgatagtttgtgtgtttggtaaccgcaatgactgcaacgataatcaaagcctcgtgcaattctatctcccacgattttgtgcaataaaatcaaactttcttttgctttgccgttttcagcagcatcaatttggtattgaataaaacgatgtaaaataaatgtacttgggttttgttccagttgttggtgtaatttagtttgtgccgcaacaatgccgtctttttctgcgataagatccgataaagctaaatcaaccgcactattattgccggtttggcttgcccgaataagaaaaagttcaaagttgtctaaccgatttaattcttggtagcaatattttaatgccggtaaaatttcgctcatgtaatccgcattttgtgttagcacattttctagatgttgcaccgcacgttgatattctaaattcacaatataacgttcagcaatgaggatagaggctctaacactcgtttttgaaacattcaatgcttgttgcaaaatatggattgcttgagcttgttgttgctcatcacttcctaaagtcagggaatattcgcagtagtaatgtgctaatgcaatgttatcttccgtaggcgaaattttggcaagtttctcggcaacattgatcgcttttttccattcttttgttttttgataaatgacggctagttgttgtaaagcgttttcagcgtagttcggttcgtcaatcaataaaatataaagattttcagctcgatcataaaagcctatcgtcaaaaaatcttttgctaattgttgtttagcaagaagtttttgttcgaatgtataatttggactgctatccaatgcttgatgaatacgcaaagctctatcaacttcacctcgagaacgatataaatttcctaaggtcaattcagcctcaaattgtgaacctgtttcaatgttattttcttgttcctgcttttgtagaatatcaaggaagagatcagccgctttttcgtgttgattagataataataaattaatacctgttacataatcacgagaaaatttattgctaatcgtatcttgatcttttcttgcactacgatgccccatataccagccgtaagctgctgcaatcggtaaaagcaggaaaagtaattcgagcattatacaaccttactctcgatttttgtttaattcatcaattaacgctaattgatgctttacttggcgagataaaaaaagatttctaaattttaatttgatataaaagaaagcggtaattaaccaacctaaaagcagacctagcccaaacaagatagccactaaagttgataaacgtatttcattttgtgcaactacataattaaaggtaataatttgatcattgttagcaccaatagttacagcaactaaaacaaccgcaatcaataaaacaagacctataatatatttgatcatctctatctcctataactttctatttatggttaaactgattggaatcgctaaaagctcggtcattatgccaaaaaaataaaaaaaacgacactttacgcgtcgtttttttatattttatattacgagtaaatattaacacgctctttcagttctttaccggctttaaaatgaggtacatatttagcacttaaatctaccttttctccggtttttggattacgtcctattctagattgacgaaaatgcaatgaaaaactaccaaatcctcgaatttcaattctttcaccgttttctaatgcttgtgataattgttctagaatgtcttttactgcattttctatatctttcaaaggaacgttaggattggttgatgctaaattttcgataagttctgactttgtcataatatactcctagtgccggttggcataaatcctataattcatgccaaccaaaaagtgaataaattattcaccttttgccgctttaaatgcttcagccattgcatttggaataacaatttcttctttattcacatttgcaactgccgccgcttcttctgcttggtcttttgctttaacagatagatgaacgatacgagatttacggtcaacaccggtatatttcgcttcaacaacatcaccaacaacaacttcattgctcaaatcagctgtacgaatataaccttcaacgccacttactaattcaactttagcaccttttgcgtcaacttcaaccactttagcactgaccacagcaccttttttgtttaccgcaatgaaattattaaacggatcttcttccagctgtttgatacctaaagaaatacgctcttttgcagaatcaacttgtaatacaactgcttctacttcgtcaccttttttatagttacgaacagcttcttcacccggaatattccaagaaatatcagataaatgtactaaaccatcaattccgccttcaagaccgatgaaaataccgaaatctgtaatagacttaatcttaccggaaactttatcacctttgttgtgagtttcagcaaactgtaaccatgggttaggtttgcattgttttaaacctaaagaaatacgacgacgttcttcatcgatttccaataccattacttcaacaacatcacctaaatgaacaactttagatgggtgaatatttttatttgtccaatccatttctgacacatgaaccaaaccttcaacaccttctaaaatttcaacaaagcaaccatagtcagttaagttagttactttacctgttaatttgctgttcaccggatggttttctgcgatggctacccaaggatcttgacccaattgttttaagcctaaagatacacgcgttttatctttgtcaaatttgaggactttaactgtaatttcatcgccgacactcacaatctcacccggatgtttaacacgtttccacgccatatcggtgatatgcaataaaccgtcaacaccacctaaatcaacaaatgcaccgtaatcggttaagtttttaacagtacctttaacttctgaaccttcagctaagttagctaaaatttcttcacgttcttgactattttccgattcgatgactgcacgacgagataccacaacattgttgcgtttttgatctaatttaatgactttaaattcttgttctttacctaataggtgatccgcttcacgagttgggcgagtatctaccaatgaacccggtaagaacgcacgaacaccgtttaactcaactgtgaaaccgcctttcactttaccgttgattaaaccgataacagttgcttgttcttcgtatgctttttctaaatcaatccaagattcttgacgtaccgctttttcacgtgaaagtttagtttcaccgaaaccgtcttcaacagcgtccaaagcaacgtttacaacgtcacccactttaacgtccaattcaccttgagcattttggaattcttccgccggaatacgagcttctgatttcaaacctgcatctacgtacacgaagcctttttcgatagcaacaacagtagcgttaacgattgaacctacacgagtttcaaggtcttttaatgattcttcaaatagttgagcaaaagattctgacataattaatcttctaaatttaagttaataacgaccactttaatttccataaaaagtggggctgataataaatgtttattcaatccttgaataaacgagttcagattccaacggagagttcatcacacgactgatatgctctaatgcttgtttgatcacatcatcaattgttaattccgtgctatcaagtaataaagcatcttctgcgggtttcaagggagcgactggacgatttctatcacgaaaatcacgctcttttatctcggtcaaaatctgtgcaaagttaccattaattcctttattttgcaactgtttatgacgtctttttgctctttcttccgcactagcatctaaaaaaatttttacttgagcatgcggaaataccactgtccccatatcacgcccatctgcaataagcccttccccgtttgcaaaatctcgttgtaattgcaataacgctgttctaacttgtggaaacaccgcaatttgagacgcggcttcagccacttcttgtgtacgaatttttgtactgacattctcattttgcaaaatgatattcacttcgccatgttgtggaataaattgaatgtcgagactacgggctaattcagtcagtgccgtttcatcatcaagtgccacacctttttttaacgctgccaatgctgtcacacgataaattgctccgctatctaataatcgaaatccaagtttctcggctaaggcataacatagcgtacctttgcccgctccacttggtccgtcaacagtaataatcagatttttattcataaattgaaccttgatacaaaaatgcgtcatatatcatgacgcactttattttttattcggctaatttcttctcaacagccttcaatcgcttgtttattttatcaatatctaaagttaatgcggcagttttacgccataccttatttggctgtaacggaattccggaagaatatattcccggttctgtgattggtcgcatcaccatacccattccagtaattgttactttatcacaaatttccatatgcccattaataacacttgctccgccaattaagcaatagcgaccaactttcaaactacccgccataataacaccgccggcaacagcagtacctgttccaatatgaacattatgtgcaatttggcaaagattatctatgattacattatcctcaatcacagtcgcatcaagtgcacctcggtcaatacaagtgcaggcaccgatttcaacatgattgcctataatgacagttcccgtttgtggaattttaatccagcgaccacgatcatttgcataaccaaatccatcactaccaattaccgcacctgattgaatgagacaatctgagccgattttaacgttatgataaatattgacatttgcccaaagctgggtattttcaccaatctgcacatgtttaccgataaagcaacctgcaccaatcaccacattgtcaccaagtataactccgtcttcaatcaccgcattagccccaatggaaacatgttgacctaacgttgccgtgtcggaaacgaccgcactttggtgaatgccttgagccgctttgggtgtgctgtccatgtattgtgccaaaatagcgtatgcaacataaggatcttttactacgagcaaattactttgtgcagaacagaattcgatatcactttcggttacgattaatgcaccggcttgtgattgaagcaaatgttctcgaaatttaggattggaaataaaggtcagttggttgttatccgctttatctaaaggtgctatgtccgttacaataacatcggcgttaccacgaatggtagcgccgatttgttgagccaattccagtaaagaatatccttgcattacttagcctttgcaggagctggagccggaatagcttttagaacttcctcggtaatatttttaccgtcagcaacataaattgccgttttttcatccaatacaattgtaaagtttttggctttagctacattcgttgtagctgtttgaacctcttttaataaacgttgagtaatttcggcatcacgtttttgtgcttcagcttgaaacgctgcaacatttttttggtgttccgctaccagcttgttaaactcgtcattacgttttgttaccaatttagcaatttcatcttgacgttttttgatatcagcttgacgtaatttcggtgcatctttttccaatgctttactttttgtttcaatttctttttcaaaattggcacgtttttcaactaatgctttatctgctgcttccagtttttctgctggtgctttaaattcctcatttaatttttgaaactcaagcaagcgagcagggtgatttaaaaacaagtactctgtattaacaacagcgatattatcacttgccattgcaattgatgagcctaatgcgatagaaagagcggtcagttttactgcatttttcattgtttgaatatccttaataaattaattttaattgagttccgtacaatttaattatacgggtttcatatcagactattaattatagccgaaagttccctaaaaagaaccaccaatactaaattggaattgttcaatttggtcaccttgatattttttcagcggtttagcataagagaatactaaaggtccaatcggagaataccattggaacgcaatccctgctgaagctcttatacgagctgggttcccgtagtcaggtatatttttatttccagcaaatggtttaccatctgatttccatttagtattccatacagaaccggcatcggcaaagatagaggttctcactgatcgttggtttttctctgctacaaacggcgtcggaacaataagttcaatacttgccaatgtcatggcatttccgccaacaatatctttgctatggcatgtatatgtgttttggtttgtactttgcatacctccagccgcactgttttgcattgcactacaacctctattcccttgataaatcgcttttggtcctattgcaccatattcaaaaccacgtacagttcctatgcctccagcagaataagtttgataaaacggtaaacgtttaccgccaaaaccgtttgcatatgatcctgacaatctacctgtcagtacccaataatgatcacgatccaatggataaaaaccctgcacttcagcactcactttatagtatctgttatctgaacctgggattgttactttaccgccaacattcgctcttactccggaggtaggcaaatagccacggtttaagctgttatagttccagccgaatgaaaattcaaagtcatgcgatttaaaattccatctagcactatcaggataccccattgatttgcgatataaatcacgattatattctttcgtcacattttttaattggctataaatatgccctaaacttaaataataggagttattttcattgaccggaaaacttaaatttccacttagaccgtaagttgtacgtccataggcggctgctgtatcactttttgagttatcgtgtttttcaaaaaatgcgtttccacctaaacttacgccatctttagtaaagtacggttcgttataacctaaattaagacttgtgccataattgttgcgtgaaccggctaaactaatcgaggaacccatgcccaagaaattatcctgtttaatacttgcctgataacttataccactttcagtaccataaccaataccgaagttcagactccctgtattgcgttctttgactcgataaatgacatcaacttggtcgttaatttgttgattggtttgagtttccgtttccactgactcaaaaaatccggtacgctctagacgaattttccctaactcaactaattgagatgataaccaagcaccctcttgttgacgcatttcttgacgtaatgtgctatcggcagtaatcgtattcccctcaaagcggatttgacgaacagaataacgatgtcccgcatcaacaacaaacgttaaatcaatcgttttgttctcttcattaaagactgaactaacatctacttttgccgttgcatagccttgctcgcttaattttgcttttatcaattgttcaacactgctaacttcactacgacggaaagtttctccgacataaatttttttaagtaacggtgctaactcttctgacataccgcctacatcaccaacgattcggacactatttacagaatacttatcaccttcgttaacttgaattctaactctaacctcagttttttcgtcatttagctgaacatcagtaccaacgatttgaaattttgcataaccatgttctaaataaaaatcacgaataagatccaaatcttggttaaattgattggtatcaaatttattcccaaataacttccaccaagcatccggctgtaattccatccgctcttgtaattggctactgctaaatgcttcattgccctcaaaacgcacttctttcagttttgccacatcactttcttttattttaagttttacttctgcccgatcatttgataatggattaacaattgcctctacagtcgtattataacgaccgacagactgataatgatcaactaaacttccacgaaacgcttccaatttttcccgatttaaaatatcaccgctagcaaatccgttcgctttcaagttttctcgtattgcttcactaggaatagattcatttccctccactttcacttccgcaatcactaagcgtggtaatacagaaatgactaaggtatttccttcacgaacagcttgcacattatcatagccacgcaaaaataatagtcttacgacatttgaaatatcactctccgttgctttttgtccaattcgaaccggcaatccggataacaccgcactttccttacctgcttgaataccgtttatacgaatatcttgcacgacaaacggtgcggcaaccagaccagtcgagccaaataataggcttgcaattaacagttttttcattgttagttctatcctctaataaagaaatatctaagagtctgtttatcgattaaacaaaatcctgacgattataaacgtaaaaaatcattaaacaatacaaatattgttaatatcaataataatcccgcaccaattttatacgcaatattttgcatttgctcagataagggcttacctttgagtgcttctatggctaaaaaaagtaaatgccctccatccaataccggcaatgggaataagttcataatacctaaattcacactaatcaacgccataaagctgagatagtacacaaaacctatttccgaagatgccccagcacctttagcaatggaaatcggaccacttaaatttttagctgaaaacactcctgtaaacagcttaccgataatttgaatagttaatttgctcaattgataagttttctcaataccttttataaacgcctcaaaaaaaccatattttaattctgtacgatattcatcacttataggataaatagtcggtgcaacaccaacgaaccatttccctttttcatttaagtgcggtgtaatcaccttatccagccattctccatgacgtaatacttgaacattgaaactatcccctttatcaacaaaactgataaaatcacgccatttcattggttcattttgataatagatttgatcaccaattaataaccctgcccgttgtgctggagaattttcaacgaccttagacagtatcatctcaattttagttcttaccggaacaatccctaatgcaccaaaggccgtttctttttcaggatcaaagttccattcagataaatccaatacttttctttgctcgatatttgttgttgaggacttcaaaagtgttagcgtaacgctttcctcccccatttttgtagcaagaaccatattgatactttcccaatccggtgtcgatgtcccgtcaattgccataatttgtgagtaaggttcaagccctgccttctctgccaaagattgaggaaccacattttcaataacaggtttaatactggggataccgatagaataaaccgtcaaataggctaaaatcgcaaacagaaaatttgctataggacctgccgcaataacaaaagcacgttgcaaaatggatttattgttaaaggcttgtgattttaagttgtcaggaacttgttcattacgttcatccaacatttttacatatccgcctaaagggattgcggacacggcaaattccgtgccttgtttatccactttagaccacaagactttaccaaagccaatagaaaaacgatgaactttaataccgcactttcgtgctgcccaaaaatggccatattcatgtactgaaaccaatacaccgataacaatgataaaagaacctaaagaccaaagaaatgacataataatctctacaagaaataaaaatagaaataagcaaaaaacggaactgccgccgttaaactgtcgatacgatccaatattccaccatgtcccggaataagttgactgctgtctttaataccgcactcacgtttgaacatactttccgtcaaatctcccactatggaaatcgctactgtagcaacagataaggaaataaaagacagacgttctaacacaaaaagatctgccggcacaagattaatgaaaagtgcggcgaaaatacccgcagtaatcaagcctccaaatgccccctgccacgttttccccggtgaaactttcggtgctaatttatgtttacccaatgctcgacctgcaaaatatgcacctgaatcggctgcccaaactaaaataaatacataaagcaatagcattaaaccatcgtaaggactagaaacgtaattgtccaaacgtaaacgtaatacagcgatgaaaaaagggatcaaagtgcagaaagcaaaaataaattgtaagaaagaggatttagcccaaatttttgccgaagcaggataacgaataacaaaaaataaggcgatgaaccaccaaattaccgccatcaataatacaggttcagcatagttttcaaacactctgccaactgttaaaaaatgtgcctcaccaaaaatccataaaaaaataaaagccccaaacagcccagtaatcattaaacgccaaaaaaattgtttaacgccaccaaactgtgtccactcccaaatacctaaagcaacaacgacaccaagagataaagcaaaatagaaaggggaaaaccataataacgcaatcaaaacaaccgcaattaatacgatagctgataatattcgttctttaagcactactcttctccatcattccgaactgccaaaacgacgttcacgttgctgataagccaatatcgcttgattaaattcctgttcattaaaatcaggccacaatgtatcggtaaaatacagttccgcataagcaatttgccataataaaaaattactaattcgttgctcaccacttgttctaattaataaatctactggaggttgtgaacctgttgttagatgatgttgaaaaatttgttcatcaatctcatcaatatgcaatttattttcttttaccaattgtaccaattgacatgtcgcctgaacaatatcccaacaaccaccataattcgcagcaatatttaaagtaagtgcggtattattttccgttaatttttctgctcttttgattttttcttgcaaacgctcattaaattgagaaacatcaccaataatttgtaatttaatgttatttttatgtaattttttaacttcaatatccagtgtttgcataaataaggacatcaaagcacttacttcactttcaggacggctccaattttcactgctaaaggcatacaacgttaaaactttaattccgatttttctagcataagaaaccgactctcggacagccttaatcccatttttatgcccccaaatacgcatttttccctgttgtttcgcccagcgtccattgccatccatgataatcgcaacatgctgaggaatattgtttaaatttaatgctgttttcgtcattatttaatcgatttttatcgaagtgaaattcggttgcgactataccataagttgatacggcttgctatgaaaaggcaaataaacagaaaaaaaatcctcttttaatcggtaaaaaacataagtttagtcgtttagttttcaggcttaacaaataaaatctcaatgttttcatcattaatgctttaaagctgatattttcttttatcaccaatatcaaaatgtaaaggcattctccatttttgaaaagaaactataagaaaaagtaccgcacttacgaccgataaaatatacaccatataagtcaaattaaattgtaggcttaaccaaagtatcgcaacaaaaaatggttgtaaatttaatgcaaacacacggaaacaaaaatattctttgaatgctaatccccctaaagtcaacaatgctccgcccagtgcaaactccggtaaattaaatagttggcaaattaatgcagcccaagttgccatttgtaataacaagcggatattttttaaataaatatgcaaagaagaggcacataacgttgctgcaataagtataccgtaatgtgcaatttccggcttataaggtaaaagtgcggtcatgattgcggctaaagtgaaaccgcaacgatataaaataactgttagataatcccaatgatccataggggatttaatttgaggatctgccatattatgttcctgatgtacgtaaaacaaagctattagccaattctcttgcctgcttatctaccagcaatacatcttctatactggtaattacttggctttcaattttttctaataccgctgtgttaatttttgctatatccgtaaattttattctcttatttaaaaatgcttcaacagccatttcatttgccgcattcaaagctgttgttgcatattgtcctgctgagaaagcctctatagctaattttaaacaaggataacgttggtaatccggttttaagaaagtcaacccacttaattgataaaaatccaatggttcaacccccgcaaaagtgcggtgaggatatgccatagtttctgcaatcggtgtacgcatatcagggttacccatttgtgcgataaccgaaccgtcaatataacgcaccatagaatgaataatagattgcggatgaataattacttccatttcatcagcactggcattaaataaccagcgtgcctcaatatattccaaccctttattcatcatcgttgcactatccaccgaaatttttttgcccatagaccaatttgggtgtgccactgcttgctcgggcgtaatatgttcaaattctttcaaatctgtataacgaaaaggtcctcctgatcctgtcagtacaattttactgatgcccaactgctttaatggacaaaaaccaattttttgttgagcttgaggaggtaaagattggaaaatagcgttatgctcgctatctaccggcaaaagttgagccttattctttcgtacttcatcaataaaaatcttgccacaggttaccaatgtttctttatttgccaataggatacgtttacctgcttgtacagcggataacgtcggcaataaccccgccgcaccgacaatagccgccattacttgatctgcctcaggatgagcagcaagttcgcaaatcgctttttgtccgctcaacacttcagttttactctccaagaatgccaacttttctcgcaattttttcgccgcactttcatcattcattgccacaaagtgcggttggaattttataatttgctgtagcataagttcgacatttttaccgccaactaatgcaagagcttgatattgctccggattctttgcaataacggaaagcgtactggtaccgattgagccggtagaaccgagaatgacaagtttttgtttattattcatactattacaaatttatcaaatagataacaaaaaacgcagtaaaaactgcgttttcgctaaattaatcatattagaaatcaagcaattctttttctttgtcagccaaaatttcatctacttttttcacgaaagtatccgtgatcttctggatttcatcttgtgctttacgctcttcatcttcactgatttctttatcttttagtaaggctttaatttgatcatttgcatcacgacgcacattacggatcgcaattttaccttgctcaccttcgcctttcacgattttaattaaatcacgacgacgctcctccgttaatggcggaagaggaactcggatagttgttccagcagaagacgggtttaaacctaaatcagatgttaaaatcgctttttctaccgcactaatcaaagaacggtcaaatactgttactgccaaagtacgtgcatcttcagccactacgtttgcaagctgacgtaaaggtgtcggtgaaccgtaatattccacttgaataccatctaacaaactaggctgtgcacgacctgtacgaattttagcaatatgtgctcttaatgtttcaaggcttttttccatacgctgttgcgtatcttttttaatttcgttaatcacaataattcctttaaaaataataagataagtttaaaatctttgttaatttactactaatcgcaaattaacgtcccttctgttttacctaaaatgacattgtgtaatgcacccgttttgctcatgttgaatacacgaattggcatattatggtcacgagcaagtgtaaatgcggctaaatccataacttgtaattctttttctatcacttcagcataagataatttgtggtaaagcactgcgttgggatttttcacgggatcgcaatcataaacaccgtcaactttggtcgctttcaacacaacatcagcctcaatttcaattcctcgcaaacaagctgctgaatctgtagtaaaaaatggactgccggttccggcagagaaaatgactacccgtttttcacataacatttttatggcttccgaccagttgtatgtatcacaaatcccattcagttggaaagctgacattaatttggcatttacattggcacggtgcaacgcatcacgcattgccaaaccgttcatcactgttgcaagcattcccatgtgatcaccaacaacccgattcatacctgctttagctaacttggcaccacgaaataagttgcctccgccaagaacaactccaacctcgacacccaaccccaataaccctttgatttccagtgccattctatccaagatagacggatcaataccaaaaccctcgtcgccttgcaacgcttctccacttagtttaagtagaatgcgtttataaattggttggctcatttccttacccctttcaataacccagagacaaaatctcgcttattatagttcaacctgactagcgtgcaagtattcattgaaaaatacccctaattattttaaaccggttttaagtcaggattaatcttgaacgctaatttatttacacttggatactgacgttggatcaattgcaataaaggcgattgctgaaagaggaaagcttgtcgtacagttgcattaacgacttcaatccacatagtgtcagattcaaaattgataacacgataaaaccccttgaactcaataggaaataaatgttgtatttgttcatttaattcatctaacaacgaggctttatgaatcattttcatcaatggagaaagttccaataactcattgaaattgatcggtttgctgtatctcatcttgattttccaagttttaacctaatattttatgtagaattatgacattgtaacgaatttccgttacaatacgcagaaaattttgtggtaatgtaaaacaatgattttaattaaagggaaacagtatttttggtcgcaactgctattaagtgtcatagcgttctttactttacccgttgcacaggatatagctccacaaaagattactaatgattacccaaaaacacaaaatgtaatacagcaactttactataccgcatcaaatattcaacaagtgcaacagcaacaattacgacaaattcgtcatgttgttactgaatcatcaattccttttcaatttgtaccgctctttttagttggacaattcagtcatctcccccctattcgtgccggtccgtaaagaaattaaatttaaatttatttcagtgccaaatattattaggcgaatttgtttattcaattataaaagaaaaatactatgttaagaactattgttacaaaaatctttggcagtcgtaatgaccgcattttacgtcgtttagctaaacaagttaaaattatcaataaattagagcctgaatttgagcgtttaaccgatgaagaattaaaatccaaaacaactgaatttcgtgcaagattgaaaaatggagaaaaactggaaaatttaattccagaggcatttgcaaccgtgcgtgaagctagtaaacgtattttaggcatgcgtcctttcgatgtgcaattaattggcggtatggtgttaaacaatcgatgtattgcagaaatgcgtacaggtgaaggaaaaaccttaactgcaaccttaccttgttacttaaatgccttaacgggaaaaggtgttcatgttgttaccgtaaatgattacttggctcgccgtgatgcggaaaccaatcgccccttattcgaatttttaggtatgactgtaggcattaatgttccggggttatcaccggaggaaaaacgtgccgcctatgcagcagatattacttacgcaacaaatagtgaattaggctttgattatttgcgggataatcttgcacattcagctcaagatcgctttcaaaaacacttacattatgctttagtagatgaagtggattctattttaattgatgaagcccgtacgccgttaattatttccggtccggctgaagacagttccgagttgtatatggcaatggataaactgattccaatccttatccaacaagataaagaagatactgaagaatatcaaggtgatggggactttacactggatctgaaaaataaacaggctcatttaaccgaacgtggacaagaaaaaattgagcaatggttaatggaaaaaggttttattaatgaaaatgaaagcctctactcccctgctcgtatttctttattgcatcatatttacgctgccctacgagcacacaaactatttgagcgtgacgtagattacattgtaaaaaacggtgaaattgttattgttgatgaacacaccggtcgtacaatggctggtcgtcgctggtctgatggcttacatcaggcaattgaagcaaaagaaggcgttcaaattcaaggagaaaaccaaaccgttgcttccatcacttatcaaaactatttccgtctgtatgaaaaattggcaggtatgacagggacagcggatactgaagcatttgaatttcaacaaatttatggtttggaaaccatcgttatcccaaccaataaaccaatgattagagatgatcgcactgatattatgtttgagaacgaaaaatataaatttgatgcgatcatcgaggatattaaagactgtgttgcacgcaatcagccggtattagtaggtacgatctctatcgaaaaatcagagttactttccaatgcactaaacaaagcaggcatcaaacataatgtcctgaatgccaaattccatgctcaagaagctgaaattatcgccaatgcgggatatccaagtgcggtcactattgctaccaatatggcagggcgaggaactgatattgtactgggcggtaactggaaagcggaagtggctaaattaaacgatccaacagaagagcaaattgaggaaattaaagccgcatggcaaattcgtcatgatacagtaaaacaagccggtggattacatattattggaacagaacgtcatgaatcccgccgtatcgacaatcaattgcgtggtcgttcgggtcgtcaaggtgatcccggttcttctcgtttctacttatccttagatgatgctttaatgcgtatttatttaacagaaggtaaattaaacttcatgcgtaaaatgttcacagaaaaaggtgaaggcatggagtcaaaaatgctagcgaaagtgattgctcaagcacaagcaaaagttgaagcacataactttgacggacgtaaaaatctgcttgaatttgatgatgttgcaaatgatcaacgccatgcaatttacgaacaacgtaatgctttactggataatgaagatattgccgaaactattcaggtcattcgccaagatgtcttcaatcatgtcattgatgaatatgtcccgccgcactctttggaagaacaatgggatattcctgcattagaaacccgtttgaagcaagactttgctcttgatttgccgttaagtaaatggctggaggaagacaatactttcaatgaagatgtattacgtgaacgtgttttaacagttgctatttctgaatataaacgcaaagaagaattggtaggtcaggaaactatgcgtaattttgagaaaggcgttatgttacaaactcttgatgaactatggaaagagcatttatcggctatggatcatctacgtcgaggtattcatttacgtggttatgcacaaaaagatccgaaacaagagtacaaaaaagaatctttccaaatgtttactgacatgttagatacattaaaactaagcgtcattactacattaagccgagtacaaattcgtactcaagatgaagtagaaaaagcggaacaggctcgtcaaaaaatagctgagcgtgaaaatgccgcaatgcaataccaaaataatgaaggaacatcatcacttcacgaaaaatcagaacataagataggacgcaacgaatcttgcccttgtggttccggaaaaaaatataagcattgccatggtagcaaagcaaaatattaattaatatggcggtggaaatttccaccgcactttttaggataaaaccatgataaaaccaacaatccaagttgccgctggcattattcgtaacgagtttggacaaatttatctaactcaacgactagagggacaggattttgctcaatcattagagttccccggtggaaaagtggatcaacatgaaacacctgaacaagcactggctcgtgaattagaagaagaaatcggtattcatgttctaagtgcggtgctttttgaacgtttttcttttgaatatccaactaagattattcaatttcatttttatcttgtcgaacaatggattggagaaccgtttggacgagaaggccaagaaggtatgtgggtcgatcaaaatgagcttgatgacagtcaatttcctcctgccaattttaaacttattcaacgattactagcagaaaaatagcgataacaattatcttctcgttatatcagctttataatcgtatacaaacaagagggcatttacaaatttagcattttacgtccgcaataacattcaaaattcttttatctgatataggatatttagtgcctagttgttgagcaaataaactaactcttaattcctcgatcatataaggaatttctttaacttcactcgagtgcggtttagatttcggcagttttgctaaaagttgttggtacgcatgactaacctgttctactctgagcattgcagcacgatcacgattaatatcttgtgctaatttatcaatacgcttatcaattgcctgtaaataacgttgaatatcagacaaacgcccataacctgttttcgttacaaattccggataaataagtccattcatttgtgtttttatatcagcaaaagcaaatgccattgtaaaatccatttttcctttcaggcgttgattgatttcaaaagtcaaggtcaggattttttcaacttgctgtgcaatttccactgtaacctcattcagattttctcgaataaaatcacgcaatctctcaaaatcagtttcattccaaaccaaaccgccaaaatcagcaataagtttatccacggcacaagcaatgcaatcatcaattaaatctaaaactcgtccgaaaggcgtaaaatacaagcctaacttcgatttgttcggcaatttttcatgtaaatatttaatcggcgaaggcacatttaatagcaacaaacgacgtaatccttgctgcatagtaacttgctgttcaagctctgtttcaaatagtttaatgccgactgaatctttttcatcaacaatagcaggataagccttaatgctaaaaccttgttttttctgttcataaaattgcggtagtcgagcgaaattccaaacatgaataccgctttgttcaataccactatctgcaacgcaggaaatacttttttgcactttatcttttaggctaaatttcaattgatctaaatcaaggctttcggcaattttgcctcccttttcatcaatgaccctaaaggtcattcttaagtgcggtggaatctgtgctaaattccattcttcaacttcaatctgaactccgctcatacgacgcaattcatgactaagcgtttctagcaaaggtttgtcggtttgcgttattcgacctaagaaagcactggcatagttaggtgcgggtacaaaattacggcgtaaagatttaggtaaagatttaattaaggcaataactaattcttggcgtaatcccggaatttgccaatcaaatcctttcatttcaacctgatttaatagtggcaatggaatatgcaccgtcacaccatctgcctctataccaggttcaaattgataagttaattttaattttaaattgtcttgataccaaaaattggggaaatctaatgtgttgatattggcattgtcttcgttcatcagaaaagacttttcaaaattcaacaattcaggttcttgttgtgcttttttcttccaccaactatcaaaatgtttttgtgaaacaacatcggtaccaatccgttgatcatagaaatcaaataaagcacgctcatcaactaaaatatcccgacgacgtgttttatgttccaattcttcaatttccttaattaatttttgattggcaaaaaagaatttgtgtcgggtattccaatttccctctactaaagcggattgaataaaaatttctcggctggtaacagcatcaatagcaccataattagcaagcctattagttacaatggggataccataaagactgactttttcatttgcaatcacttgtcctcgagactttgaccatcgaggttctgaataactggatttaaccaaatgtttcgctaacggttcaatccattccggctcaatatctgccattattcttccccaaagtttagaggtttccactaattcggctgctacaacccatttaggttgttttttaaataaaacggaattggggaaaatagaaaaatgtgcatttcttgcccctaaatattgctgtttttcattttctttcaatccaatatgggatagcaatccacttaaaagtgcggtgtgaatttgtgcatattcagcctcatgagaatttatgggcaaccccatttcacgcacggttaaacgaatttgatgataaatatcttgccattcacgaatacgtaaataatttaaatactcttttcgacacaagcgacgaaattgatttttgcttaaaattttctgttgctcttgaatgtaattccacaaatttaaataagctaaaaaatctgattttttatcagcaaaacgacgatgtttatcatccgcagattgttgtttttcttgcggtctttctcgaggatcttgaatagataaggcagcaacaataatcatgagttcatgtaaacaagaaaattgtaccgcacttaataacattttagccaaacgaggatcaacgggtaattgtgctaactgcttaccaatagcggtaagctggcgtttctctccttgcttgttttttttccattcaaatgcctgcaactcctccaagagcttcataccatcttggatatgacgtttatccggggcatcaacaaaaggaaaagcttctatatcatctaaacctaaggcggtcatttgcaaaataaccgatgccaaattggtacgaagaatttcaggatcggtaaattccggacgattattaaaatcatcttccgaatacaaacgaatacaaatcccttcagacacacgcccgcaacgacctttacgctgattagcggaagcttgtgaaattggctcaatcggcaaacgttgtactttagtgcggtagctgtaacgtgagattctcgccgtgccgggatcaataacatattttatacccggtacagttaatgaagtttccgctacattagttgccaacacgatacgctttaaattactcgggtgaaaaattttattttgttcttgtgctgaaagacgagcaaagagcggtaagatttctgtatgttttaaatctaatttttgtaatgcttctgcagtatctctgatttcccgctccccatttaagaaaattaaaatatcaccgactttctctgcctgtagctcatctaccgcatttaaaataccttgtaactgatcttgatcctctgcctccacaattggacgataacgtacttctacagggtaagttctaccggaaacttctataatcggggcatgattaaaatgttgagagaagcgttctacatcaatcgtcgctgaagtaataattacttttaaatcaggacgctgaggcaacagctgttttaaataacctaaaataaaatcattgtttaaactgcgttcatgtgcttcatcaataatgagcatatcatattgatttaaaaaacgatcagattgaatttctgccaataaaattccgtctgtcattaatttaatttgtgtttcatcgctgatttgatcatgaaaacgaactttataacccacgactccaccgagttccatatttaattcttccgcaattcttgcagctacggaacgtgcagcaatgcgacgaggttgagtatgtcctatcaatcccttctgcccaaaacccaattctaaacacatctttggtaattgagtggtttttcctgaaccggtttctccagcaataacgactacttggtgttcccgaataagtttctggatttcagcttttttttgattgaccggcaagttttgtggaaattccattttttgtaccgcactttgtcgttgtaaaaaacgaacttgtgcctgttgaatttgctgttcaatttccactatcaccttgttgatattcgtaggatgtttaagttgattcatgcccttgatacgagcaaacaaacgacgccggtcaatcgacatcatgtcgttaagctgtaccaataatgcctgctgttgtgtgctaaaaacattttttttattattcttcattattcttattttcaaatttagtcaatcatgtaacgctaaaaattatttatccagtttttccaataaacaaagacaaaatccccgctgcaattaacggtccaacaggaacaccccctaaaaatgcgacacccaaaatagtccctactaataaacctgtgagtagcgaaggttgcgtccccattaaattcacaccacgtcctccaaaccatgcaacaagcacacctaccgccatggctaaaaacattttccaatgaataagtgcggtccaattcggcaactgaaccttgcctgaaacgatgggactaagtacgccaatggtaagaataataataccaatattaactccatacttttccgtaaaaggaatatatttggctaaaaatgtttgttgcattaaaagtaaaatagttgcggaaatggttatggagctattattgcctagtacaccaagcaaaataaggctgactaacaataaagcaattgagttaaactgtaacgacattgaaatattcctaacggataattaattctcataaaacggtgctaattatagcaattttctacatgcttgcgactttttcgttatcaataaaaaagacattacagcaattatttaacaacattttaataattaaaaaacatctcatttacttaaataaaatttaaaaaataaacaatatattaaatataatttcaatttttagggtaaattttatttttttatattttaaaataattctatttgacctttcaattatttttgggtatatctaccccatcaaataaatttgtcatctttttaagtgaggatcttatgccccaaaaatactcaacgctaaaaaataacataaatatgttaggtcactttttaggcgaaacaatcagcgatgcacagggtagtgatattcttgatttgattgaaaatattcgtgtattatctcgcgactctcgttccggtgatgaaaaagcacgggaaaaattattagatacgctttcgactatttccaatgaaaatattattccagtagctcgtgcttttagtcaatttttgaatttaaccaatatagcggaacaataccaaacaatctcacgaaaacacatagaccaagttgcctccgatcgttctttagaggcactctttgaacgcttaaaagcacaaaatgtaccggcagaaaaagtcatctcaacagtagaaaaattattaattgaattagttttaaccgcccatccgacagaagttacccgccgttctcttttacataaatatgtagaaattaaccgctgtttaagccgtttggaacacgatgatcttactcaatcagaaagcacaaaattaaaacgccgtttaatgcaattaattgcacttgcttggcatacaaatgaaatccgtacgcaacgccctactcctgttgatgaagcaaaatgggggatagcggtaatcgaaaacagcttatggaaagccgtgcctgatttttgtcgtcaattgaatctctatttagagaaaaattttggtgtacaacattcagtaaacttagcacctgttaaattttcttcttggatagggggagatcgtgatggtaatccatttgttaccgcagagacaactcgccaagttttaatcatgaaccgctggaaagcggcagaattgtttttagcggatattcaagttttatcagaggaactttctgtagttcattgcactgaggaattccgtgccaaatacggtgatcatttagaaccctatcgtgtagtcgttaaaaatttgcgagcaaaactggtaaaaactgtcgcttattacggtgaaattttagaaaataaaccttcaaccatcaatacaaatgacattttgaccgatgatcaacaactttgggaaccgctttacgattgttatcaatctttacatcaatgcggtatgcgaattattgctaacggtatattgctggattgtttacgtcgtattcgttgctttggtctctctttgtctcatttggatattcgtcaagaaagccttcgtcatactaaggctctctctgaaattactcgttatattggtttaggcgactattcacaatggatggaagatgataaacaagcttttttaatccgtgaattaagctctcgtcgtcctttgctacctcgcaactggacgccttctccggaaacgcaagaaattttagaaacttgtcgagttattgcacaacaacctgaaggcgttatatcttgctatattatttctatggctcgcactgcctcagatgtgcttgcagttcacttattattaaaagaagctggcgtaacctattatttaccagtagttcctctttttgaaaccctagatgacctcaatgcttctaaagaagttatgactcaattatttaatgtaggctggtatcgtggtgtgatcaacaataaacaaatggtcatgattggttattccgatagtgcgaaagatgcaggtatgatggctgcttcttgggcacagtatcgagcacaagaacaactggtaaatctttgcgaaaaaatgggagtagaattaaccttgttccatggtcgtggtggtactattggacgtggaggtgcacctgctcatgccgcacttctatctcagccaccccgctcattgaaaaatggtctacgtgtaacagaacagggagaaatgatccgttttaaactgggtctacctgcagttgcagtaaatagctttgatctttatgccagtgcaattttagaagccaacctgcttccacctccggagcctaaagaaagctggcgtgcaattatgaatgaattatccgattcatcatgtaatatatatcgtagcgttgtacgtggagataaagattttgtaccttatttccgttccgccacacctgaacaagaattatctaagttacctctaggctctcgcccatccaaacgtaatccgaacggtggggtagaaagtttacgtgcaattccttggatcttcgcttggatgcaaaatcgcttaatgttaccggcttggttaggtgcaagtgcgtctattcgccaatcaattgaaaaaggcaataaagaaactattgaagaaatgtgtaaaaattggccgtttttctctacccgtatcggtatgttggaaatggtgttcagcaaaactgatacgtggttatctgagcattatgatctgaacttggttaaaaaagaattatggtatttaggtcaatctttgcgtgaacaactgcaagccgatattaaaactattctttctttatctcatgaagatgaattaatgtctgatttaccttggattgcagaatccattgccttacgtaatatctataccgatccgctcaacttactacaagtagaactgttgcgacgtttacgtgaaaaccctgaaaatccaaatcctgatgtggaacaagcattaatgattacgattacaggtatcgctgcaggtatgcgtaatactggttagtgatgaactcatcatacaaaagtgcggttaaaatcaccgcacttttttctacttctcacttttgtgctatgattatttcacttttacttatgagaaaatacgatgacagaccaaattaataaattagatcctgatacagcaattgatattgcttatgatatttttctcgaaatggcgggagaaaatcttgagcctgccgatattcttttatttaacttacaatttgaagatcatggcggagttgaatttgttgaaactgccgataactgggaacaagagattggcgttctcatcgatcctgatgaatacgctgaagtttgggttggcttggtcaatgaacaagacgaaatggatgatatttttgctaagtttttaatttcccacaaagaggaagaccgagaatatcacgttgtgtggaaaaaataatccaagctcaaaattgaggaaaatttgcgattcaatagcctcttcgtatagttgctgaacttccgattttgctatttaatacaaatcctagaatattactattccaaataagaagagcggagaattccgctcttttagccttcaaatgcgttgtgattagttgaacatggcagaaatagattcttcattactaatacggcgaattgactctgccagcatacctgataatgttaatactcggactttacccaatgccttaatttccggtgtaaatggaatagtatcagttacaacaatttcatctaatgcttcattcgctagattttttgccgctgctccggagaatacggcatgagttgcataagcaaatacacgttttgctccccgctcttttaatgcttccgccgctttgcataatgttccgcccgtatcaatcatatcatcaactaaaatacaatcacgtccggcgacatctccaataatgtgcatgacttgggctacattggcttttggacgacgtttgtcaataatcgccatatctgtatcattcagcaattttgcgatagcacgggcacgaacgacaccgccaatatccggagaaacaacgatcggattttccaaatctgttttctttaacatgtcatgaataagcaccggtgaaccgaatacattatctaccggtacatcaaaaaatccttggatttgttcagcgtgcagatcacaagttaacacacgatctactcctacgctcgataggaaatccgctaccacttttgcagtaatcggtacacgagctgagcgtacacgacgatcttgacgagcatatccaaaataaggaataactgcggtaatacgccccgccgatgcacgtcttagtgcgtcaaccataacgactaattccatgagattatcatttgtaggtgcacaggtagattgaataataaatacatcacaaccacgtacattttcattaatttgaacttgaatttctccgtcactgaaacgaccaacagtcgcatcacctaaggaaatatataggcgttcggaaatttgttttgccagttcaggtgttgcattaccggcgaaaagtttaatgtcaggcatcgtaaatttaacctctggaatttgtattattaggaagacaaagtgtttgtttttgttgcgataaatattcaatcatttgatgtaatggtgaaatatttgttccctgagcaacaaaaccaacgtatttttcaggtttatcaagaaatgcagattgtgccgcctgttcgttagcaaattcagcgaaaacacaagctccagttcctgttaatcttgccggtgcatattgtaacaaccagccaagggcttcttcaacctctgaataatgatttaaaacaactttttcgcaatcgttttcatattttgttattaataattccgctaaaggtcgttttggggtattgcgaggtaagttaggatctttaaatataatagctgtagaaatagatgtttcgggttttaatactaaaaaccatttttgtggcggttgacaaaaagtaagtttttcaccaacaccttcggcaaaagcggcttttccatatacaaaaacaggcacatcagcaccgagctgtaatcctatttcagcaagtgttgagagtgaaagttgtgtattccataaatagttgagtgcaacgagtgctgtggctgcatttgatgatcctccgccaacccctccgcctattggcaaaattttatccaaatgtaaatttgcccctaatgtacaccctgttttttgttgtaataatttagcggctcgatagattaaattatcctcgttttttagatgaggtatttcgggtgttaagattatttttccgtcagtgcgtatctcaatacttaaccaatcgccaaaatttaaaaattgaaataaggtttgcagttcatggtaaccgtcggggcgttgagaagttatatataaaaacaaatttatctttgcagggcaaggaaaacgtaatttttttccttgtatttgcgatgataaaagtgcggtcgaaaattgatagtttttcattaatatttccagttatctatcctaacttttaaggtctgctcactacttttcagaagaatatctttgggtaatggaatgctttgatctgttcgatagttgagatagtcagcactccaaacttcaccctcaactgaataagtaaagcttgctaataaatgatttatgccgacctgataatctgaattttcatctggttgaccttttagccagttccctatttgttgtaatggaatagagataccaatcatttcacggagcaagttgttgatatcttttgttgaacgctgatttcctttatggtctgaaacagtaataccgaaaggtgaaacttcaaatttaagtattgaactgctgaaagctgatgaaagtagtaaagaataggattgcggattgttatattgccaagtaaagcgagtggaaaaacgttgtttattgttaatataacccaattgtccttgagcttgatattgttttatttgcttaattttttgtaggtgttgttgccattttttatcatttttttctatatactgaataccttgcgggcgttcgccggcaatatctaaagtacaagcactcagcaatatcgttaaaataagtataaaaaaaggtttttgagatgttttcatgtgtcggactcgtaaaaatatcgaatattttaaggtcttacataagattagtaaagatacaaaaacttttgattttttgaccacactttgatctgtttattaaaagatgctaatttaaatttatttgaagggtggcttacttcaatttttacaatgatctctttttaaggaaacacaatgaaaaaatcatttatctcaattgtggcgttagacttattgggagcggtttgggttggtacttcttggtataccggtaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtaaattgtaggttggctgatttttatactctgccaattttttctcaacaaaggggattatggagaaattttaaccttgaaactaattgcccaaagcaacttgtttggaaataactttatacataatggtgattatagttgctatttttttgaagacgaacaataatagtgtgccgataagcaagaacaaatgatttttgcgaggatattttttgataaactacgatatggttatttttccgtatcgtagttttgttttacttaaaaaggaagtgtacaacaatgaaacaaattccaatgactgtacgtggtgcggaacaattaagagaagaattagattttttgaaaaatgtgcgtcgtccggaaattatcaaggcaatttcagaagcacgtgaacatggcgatttaaaagaaaatgcagaatatcatgcggcacgtgaacagcaaggcttttgcgaagggcgtattcaagaaattgaaggtaaattagcaaattgccaaattattgatgtaacaaaattacctaataatggtaaagtgatttttggtgcaacggtcgttttgttaaatattgataccgacgaagaagtcacttaccgaatcgttggagatgatgaggcggatattaaatcgggtttaatttctgttaattcgcctattgctcgcggtttaatcggcaaggacgttgatgatactgttgtcattacaacacctggcggtaaagttgaatttgaaatcgttgaagtagaatataaataacataacactttgataggaaaaaaatgggcttaatgcccattttatttgtttcagttattggcgaggtaactgaattttgggttcattacttggacgataaagtacaagaacatgccctatagtttgtaccgcactggcttgcgtttcacgtataattgcctcaataatcagctgttttgtttcacgttcagcaccagaaattttcactttgatcaattcgtggtgatttaatgcgttgtcaatttcagctaaaaccccttctgttaaaccatttgtgcccagcataaccaccggatttaaatgatgtgctaaaccttttaaaaattgtttttgttttgttgataatgtcattggttacccatcctacataattaaaagtgcggtcaatttgataacaatatttcaattgcctttatctcgaagattttaaccataaatccaaaaaataaaaagaaggaataattattttatagaatagttaaaacactttccggcggtcgtcctattttagctttatctccatttactacgattggacgttcgagcaatacggaattttgcgagagtgcaatcaaaagttgttgttccgttagctcctgactattcaatcctaattgtaaataaagatcgtctttcgtacgcatcatctcccttacagacgtaattcccaatttttgagctaacgtttgcaactcttcaacgttgtaagtttgctgtagatataattcaacgtcaaaaagaatggattgttgttccaataaagccaatgtttcacgactttttgaacaacgtggattatgataaattttaaccgtcataaatgctcctttgctctgatacagttcaaatatgcaaaattttaccttataatcacccaaaatgctcattcgttaaggataaattatgattgaaatgttaaaaaattggtatcatcgtcgctttaccgatccgcaggcgatggcacttttcgctattttattctttggctttgtagcaatttattttttcaatagtttattggctcccctcctgattgcgattgttttagcttatttacttgaatatcccgttcgcttattacatgaaaaactgaaactgcccagaattttggcgacatctcttatactcggtggctttatagcaatcacatttgtcatgacctttattttgatcccggtactttgggcacaaaccatcaaactggtcagcgacttaccacacatgttcaatcaacttaacgaatggttactttctttaccggagaattatcctgaattagtagattatcaaatgatagatgcgttttttatttcatttaaaaataaaatattaggcttaggtgaatctgcacttaaactgtccattgcctccttgttaaatcttgttaccttaggaatttacgcgtttcttgtgccattaatggtatttttcctcctcaaagataaaacggaattaattaactatattacaaactttctgccaaagaaccgcactcttgcctcaaaagtttggcgagaaatgcaacaacaaattgccaattatattcgcggtaaattacttgagattttaatcatagctttagtcagttatgccatttttctattttttggtttgaattattcattgttactggcagttgccgtgggattatctgttttagtgccatacattggtgcagttctggtcactattcctgttgctttagttgccatgttccaattcggtgcaaccccaactttttggtatttaatggttgcttatgtgataagccaaatccttgacggaaatttactcgtgccatttttattttctgaagcagtgaatttacaccctctcactattattatcgccgttcttatttttgggggattatggggtttctggggaattttctttgcaattccattggcaacactagtcaaagccgttgtttcatcttggccgtcaacagaataaccgataaggaagaatttcattgaaagggctatttattaggattgttttagccatctgtttatcgctttgggcaatagatatggttttcccttggcaacaaatagtgagatcaaaacagaattaccatactacaattcaagagcgacaaaaattgattgtaggaacaatcaataatccggtgtcttattttatcggtacaaacggagaaacagggctagaatatgaattaagcaaggcttttgcaaattacttaaatgttgatttggaaatgtttcctctaaatagtgcggacgcattatttcaggctttagcacaaggtaaaatagacattgccgctgcaagtttattttatcaacaagatagaagtgaaaaattcaaactaggtccggcatatcacgctgcatcttggcaattgacttatcgcaaaggtgaacgtcgtcctatcacattagaaaatttatccggcaaattggttattccggctaattcggcactgaataatattctgctggcaaaaaaagaaaaatacccttctttaacatgggaaaccagtgaactaagccaagaggaactcttatttcaagttgctgaaggaaaaatagattacacaatcgctacctctactgaagtatcagttaatcagcaaattaaacctcaaattgcaattgcctttaatgtgactgatgagtttacagtacattggtacttatctgataagggggcttcagaattacaagccgcactattagacttcatgaactctgccattgaaaacggcttaattgctcgtattgaagaaaaatatttcaatcacctcaaccaatttgactatgttgatactcgctcctatttgaatgcaattgaaacagttttgcctaaatatgctcctttgtttgaaaaatataaaggtgatttagattggcatttattggcagccatatcttatcaagaatcccactggaatccggaagcaacctcaccaaccggagtacgcggtatgatgatgttgacaaaagcaactgcagatagaatgaatattactaatcgtctcgatcctgaacaaagcattaaagccggttccgaatatttacatcttctgctcaaacaaatgccggatactattttaaaagaagatcgtatttggtttgcacttgccgcttataacatgggattggggcatttattagacgttagacgcttaaccaaacagctgggaggaaatccggataattggttagaggtgaaaaaaaatttacccttattagcacaaaaacgttattttacccatcttaaatatggctacgctcgaggctacgaagcgtttcaatatgtggaaaatattagaagatatatgaacagcataatgaattattatcggcttcaacaaaaccaacaagatcggtatgaaaatgaaaataatgatgtcatttcaatacaaacacaacaggaacaacgatgagaagaaaaacctttttaaaaaaaagtaaagtcacgctatatcgtaccgcacataaccgagcattaagaattaaacgcttaaaaaaacgtaaagcccaacaagcagcacgacatacccagcaattcgtcatacaagaaatttgttgctgatttttcgtgctgtaaaatcatattctttagcatatggatataagaccaatcagataaaaaagcggaatttccaccgccctttttgctttacataacacaccctaccaaaaccggatcgttaaattctgttttacagcaacccttaattaacaaaacattcaaggcaagcgaaaagaaaaaagaaaaagaaaaagaaaaagaaaaagagaaaagcgaaataaaaaatgattgccttattaataaattttgtaataaaatctccgaaatttattactatctgcttgacaaacaaaaataacatgaatttacagcctacagcctacagcctaggctaacgccttgttgcaaatcttgcaaaataaattttaaaaagtttttaacctytmawmatayccmaatttycccttttmaaccyctyggcgaaaatatcattcgtctttttytgctttgccttaaaaagcaaggcatcgccgatttatacctcattaatctacctaaaaaacaaaaagtttaatccattcacaaccataaaaaagtgaaaaaaaatcaacaaaataaattattaaataacccattttaaaagattaaagagaataaaccatgaacaaaatcttcaaaaccaaatacgatgtaacaacaggtcaatgtaaagccgtgtccgagttggcgagcaatcgccaaatagcaagtagctcggagaaaaagccaaagtgcggtgctaatttgaaaagaacgagcttatcagaaaacttactgttcaacatgctgatcagcggtttggtgttgtttgcgtatcccgcttgggcagcagcggctcaaactcaagttaacaatgataaagacatcaaaatagatggtaataccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcgctcaacgagtagtgctcggtaataaagcctatgccatcggtaaccaagcggtggggattggtggtgatgtattcgcccaaggctattcctccatcgccatcgggagcgatgatatcggcgaaacggctgatgagaaacaaaaagatggaagtggaaatgataaatactccaaatacgccgtccccctgcctaaagccatctggcagttgtttgttgatgagggagatcattttaattcaaaaacgaaaaatagctatgcggttttgcaaaacggtartaacggcggtaccaacggcaaagccaaaaagagttcagagttttatagcaatgggaatggtagtggaaaaatcgacagaaataaagaccctgctaaatgggaagaagaatatgcaaaatttaataaagacgcatatgaaaaatacgtcaatggcacccaaaacggtagtagcaataacccccaaaacgtctactcccacacttgggcgaaagggcgtggggcgattgccatcggggcaaggtctatcgcttacggcgaccattctaacgccatagggacacttgctattgccaagggtaactactcttccgcctttgggacgggaaccatcgcctttgaagatggcggtatcgccgtggggaacaatgcgtacgtttatcgcgaacattccattggggtgggaaataacgtccaagcaatacaaacaggctcgatggtcttcggggccaattcctacgctggcggtagcggttccttagcgttaggggaatatacctttgcgaatgtgactatgggcgatgagtttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaacaatattacaaagccaaaacaaacaaacaacaaggtacaggcgaagaaaaagccgaacaatccaaagacaaaaacggcacttataaccaaggcgggatagccatcgggtcgtattctgtcgcattgggggataacgccctcaccctcggcagacacgcctacgccaaagaagacagcacggttgccatcgggaacttcgcctttgcaaaagatgaaaacgccttcgccctcggcaaagccgcccgatccatgggtaaaaactccttggcaataggtgtggaagcggagatttggagtccagatgcggtagcaatcggcacaggctctaaagtgtaccaaaatgcygakggcggtgtcgccattggacaaagtgcggtggttgaagccaacgctggygattcyattgcgttgggtaaaggttctaaggcggaagcgaagaaacaagcctttaaaacacaagaaattaatgtaggaacaaaaggcttgatgtttractggggcagtgcaggcacctcagaaagtgatcaagaggacaagaaaaaagccgtsgtcagcgtgggaaataytggtagcgagcggattatcaccaacgttgccgctggttctgttatgaacggttccactgatgcgattaacggcggacagttgtatagtgtgattgaaacattcggcaaactcggcacrgatattcttggtgcggaagtatatgataaggataaggataagrgtmagtacggatttaaggcttcaacgtttgaaaaagtaaamtatcatcgagracagactcaaggacaaggacagcaagaacaaaaagcaccgaaaacatttaaagaggcaattgatgaaaccattaaagctgtaaattccggaatgattttcaaagccggtaatgataatggcggtagcaataatcctatcaccaaacaacttggcgacacgttaacattcaaaggcgaygrcaagtatatcaaggcgastgtagawggtrrtgctattaaatacagcgtagaagtggcaamtaacatagatgacagttcaaccccatctagtycaggtggagcaggagcaggaacaacagryycmamkgataaattagtaacagcaagtgcggtgaaaarttatgtcacgacaaaatttggtgcattaagttcaacgttgaatttagaaaccgatcaaccaactgatggcagtaaaaataaaggttcaatcaatttaaaaasygatacmttaaaaattactggcgatagtaatatcacgacttcatttgtgtctaatggtgaaaaaaaattaagtataaaacttarwgaaaatttaackrryattwmwtcyataggtaaaggtagtaatggtaccaaaatcacatttgatgatarcaaaaargaaatcaaacttggmtctgtwtcygtaagtgtaaatrrtsagcataaaatmgtaatcggtgarggttcmaaatcagawtcamamcatacacttgcmatagggaataaagccataataggtmrwrrtgcaaaaggctctatctctatagccagtctaacaaatggtgarcaggggaatataymaaacgccgaatgggcrrtktctatcggtaataaaaacarcrtywcmggcggaaatgayrttgtcgccttggggtcgaatattaatgtaagcggttctgatggtaagagtaagtctgtagttgcaataggtaatgggacacaagtaacaaatgggaaagaatcaatagcaattggcgtagcaggcaataccaaaatagaaagtgctgaatgggcggtcgctattggtaataacaccaaagtatctggcggaaacgacatactagcattgggttctaatatttcaataactggaagtaataatggaagtgtagtcgtactaggtaatggtgcaaaagctagtgccgcagaaaacagtgtggttataggtaaaggagcagaatcaaaagcccaaagtgcggtggttattggggaaggtgcaacggttgaaggtgatgctggcgattctgttgcattaggtaaaaattctaaggcgaaaactaaaaaacttgctccgagtggattagatggtaatgtcggaactaattcattaaaaatcagttggactgctggggtttctagtgatacaaatgataaaaaatcagtattcagcattggagatgcaaatagcgaaagaataataaccaacgtcgccgcagggacagtagataatagttcaactgatgccatcaatggcggtcaattaaaaagcgtcattgatgtgtttggtaagttagcatttgatgttctcggagcggaaaaagaaacagagaaagaggcagataaacaaacagttaaagacggatttaaaaaatcaacatttactgctgttcaatataagagagacccacaaccacaaggacaaccacaaggacaaccacagcaacaagcaaaagtaccaatgacattcagagaagcgattaatgaaagcattgctgctattaacaagggcttgayattcaaaggcgatatgccaagtgcggkaacaaatggyactcaaaacacaccgcactatcttggttcgactattcagattgtgcgtttggcaacgcctgcgaacactggcacaacgactacacagccagctacaactacgccagccatcacggcgtatagtggggagaatttaatcacgcaatatagcaatactaatggcaacgccaaaatcgaaatcggytttaaaaatgcaccgacatttagcaaagtaatgcttgctaaagaacaaacatataatggcggaagtggaamtggcggaagtacagattggaaaaaagaactcatcactaaaggctaccttgaacaagcgttagataagtttaagtttaaagtatctactggcgagrgtgatgataagactwttgaaatcggtcgtggcgatacrttgaagtttamgrntggyywraatattmaattgactttagmgaagmaagatggggcaacgtctrsyagtagtgcaacagcwccarccgctgcaccakcaccaacgcctgcaccakcagtggcaagcrgttcgtcargygatgyaagtwcaaatggcgrwggttcaaatggtatggcttcgtcargtggtgcaaayggcggtggttcaggcggtgcaagcatggctacgacgggaactgctccaagcacgccaactagcacaacaagcgatacgagtacaccaaccactactgcaccaaaaacagtagagctaaatattggcacaactagcgatttaagcaatatcacctcgatttcctcaccgtctaaaggagcgaatgcaggtacaggcggaagcggaagtgsgggcggaaattcaggtactggttcaaatacagamgtcaccaaacttacyttagawgctgataawggggcractttccaagtgggtagcactggtgcgaaagtgaakatyaataaagagggtattgcactgatgccacaaggggcgaatagcacaggcggatcaagtggagcagatccatctgactcaccatcaatcactattaamgcaggtkcaaaaccrgcrgatccaaaaagtttagattcacttgatcctaataacggaccttcaatagagttctcagccaagaaaacaagtgatggtaaaaccattggcacaggaaaaatcaccggtcttgctgatattaagtcagatgaaaaagacggcaccagtgcaaccaataaaaactatgtcgatggcaaagtatccgatctgaacaataaccgtccatttgatttttatttagacaaggaaaaagtcgtgaaagataaagatggaaatttccacaaagcagacaaacctactgaaaaacttactgaggaagagaagaaacaagtcgtgatcaaagccgaaccaagcaccgcacctattgggattagcaatgtggcgagtgggttgggattgcctgcccctgaaaaagatgaggaagaaaagaaaaaggcacagcaaaaaaacactgaactcaccaaagctgttgaggaaaaagtgaaagcaataggcgaaaaagctaccgcactttcaactacagctcaaaaagtaaccgatttaactttagcagtcagcggtttggaaatggcgatgaatgcaatgtctgagggcgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatagtaaagccgaattaaccaacgcagcaacaatcggtgatttgcaagcggtagcgaaatcgggcatgaagttcaagggcaatgatgacatggaaattcacacagcattaagcggtacttttgcgattaaaggtgaagaaggtgcgaatggcaataaatttaacagcgacmgcacygctrccggyaatatcaaagtggaaatgtctcaagayggcaaagggctkgaagtcaaactgtcygatcarttgaaaaatatgacstcttttgaracmcgtgaagtggacggtagaaaatctacgctaaacagcaatggtttgatagtggtcaataaaggtgcagataacaaagtcaaatcagcaacatacrgtgcggaagcgatggtgttgtcgaatcaagaaaacgacaataaagccgtggtgaccgctggcggtgtccattttgccactacccaagccccagcaacaggggctcgtgcggggacaggcgtgattacaggcttaaaagacctagacgcacgctcgacaggcgacatggcaaccaacaaaaactacgtggacgaaaaaattggttccgccgtcaatcgcttggataatgcgatcagtaccactaacagacgcttgcaggcgggtatcgctggagctttggctacaggaggattgccgatgacggtgatgccaggtaaatctatgttggcagcgtcggctggctcgtataaggggcaaagtgcggtggcattaggctattctcgcatgagtgataacggcaagataatgctacgcctacaaggtacaagcacttcaacgggcgatgtcggcggttcggttggtgtaggctatcaatggtagggttctaaacgccagcaaaactcaccgcacttattgataagtgcggtgggtttggtagggatgattagttaaatctcaccaaaacagtgaacaatgcactgtcccaaacattaaactaatttattctcttatgtctcaggcttaagatctaattttgccatgagcaattgatcgccatcttcttcaggattgactgttaccaataatttgtcaccgtaaaaaatagaatttgctcctgccataaaacacattgcctgcatttcttcagacattccttgacgaccggcagataaacgcacatagcttttcggcatggtaattcgagcaacggcaattgtccgcacaaattcagtccaatctaattcttgagcatcggcaagcggcgttccctccacttttaccagctgatttattggtacggattcaggctgaggatctaaatttgccagacttgcaattaaacccgcccgctctttgcgagtttcattcataccgacaataccgccacaacatacttttaaacctgctttcctgactttaccaagagtatttaatcgatcatcaaaatctcttgtgccgataatttctttataatgttcgggtgcggtatcaatgttgtgattatagtaatccaatcctgcctcttttaattcttccgccataccgtcttgtaataaaccgaaagtgccacaagtttccaaccccagatcttttaccgctttgataatttcagtaattttttcaatatctttcggcttcggtccacgccaagccgctcccatacaaaaacgccccgcaccacgaaatttagctattttcgctttttcgacaatttcctccacacataataattgctgattttgtacgccggtatgataacgtgcagattgtggacaataaccacaatcctcagggcatccgcctgttttaatagacatcaatgtcgaaagttggatcgtttgtggattaaagtgctttcgatgtacctgagccgcttgatacacaagttctaaaaatggtgtttcaaataacgcctcaactttgcatacagaccaatatttaacgcaaggatgcggtgttaaagagggaatgttgatagttgtgattgtcatattcttttccttatataaagtgcggtcaatttcaacgaggaatttccctctctgttgcttgaccattttttatttcaactatgcgatcaattttatctatcacttcgctcagttgatgagtaaccaataataacgttaattgtttttctctgcagaacttatcaatcaatgtcaacatttcctgacgtaaatgaggatctaacgctgaaaaaggttcatcaagtaataaaatcggtttatctcgtaacaaacatctcgctagagcaactctctgtcgttgccctcccgacaattctttaggtaaacgtgataaaaaatccgttaaacctaccgcacttgctactttttccagttgtttgatttcttctttgctcaacttcaaatccgctcttaaaccgatagcaatattttgccataccgttaaatgagtaaataaattatgctcttgaaacaaaatggaaacagggcgttgatgtggtgcggtataagtatgattttcaccatttagccggatttccccttgcttaaccggctcaaatcctgcaattaagtttagcaatgtactttttcccgctccgctttcaccaataatagcaatcttttcgcctagacttatatgtaaatcaaagtgcagagaaatattgggataatcaaaaatagtgtttaatttaatcatctttttttattcgttcaattaatataaaaatacatgtacaaaaaacgagtaacagcaatgcagttactgcaccttcgtcagagcgataactgcctaattgttgatataacaaataaggcaaggaactaaaatcctgattcccgaataaagctatggcagtaaaatcccctaaggaaatagcacaagccagtgcaaaagcatatttaaatgatgcgtttaaattatgccattcaattaaataaaatctattccaaccttgaatagccaaggattgcgatagtttttcgtaatgttgcatattgttgtacatcggtaactttagaacctgtaaaacaaaaggcatggcggttaagccattacatagtacgactaaagcaaataaatgatagtgggagaaatccatttcccttaagcgaataaataaacctactgaaataaccaagacagggatagccagcaccagcattccgctatttaaaatactctgagataaaaatgaataagacaaatagtgtaaacggcgtgccagtaataataatgaaacggaaaataacatcgctaaaatcgctgataaaggtgcaatagctaacgaataacctaaagcctgccaaagttgtgattgctgccaaatttgccataaactttgtgcttgaaaagcggagaaaacaatatttattaaaggcaagctgatgaacaataaaacgcaattgatataaaaaatttgccagatttgtaccgctcttgactgcttttctaaccaaatatttttactatgcaataacacttgtggcgatttttgccataggctacccaatgcaaacagcacacaacaaaaaattacttgtaacaacgcaaataacgccgattttgcgagatcaaattcaaataaaatggcttggtaaatagcaacttccaacgtggtgtattgaggaccgccgcctaaagtgagaacaatagcaaagctggtgaaacatagcataaaaatcaagctgaaaaccggtaatatttgttggcgtaaatagggaaattcaatcaaacggataaactgccagccacgaagatttaattgtgatgccagctgtctttgctgagttggaattgtttggaatgtttgcaaaaacattcttgcagctaaaggaatattaaaaaataaatgtgcgattaaaataccgcttaaaccgtaaatatggggttgccaagttatgcctaaaaatgttgttactttgactagccagccgttatgcccgtaaattcctgtaataccaaaaattaccactaatgcaggcaacacaaaagttaaagaaaatagtttaagaatcaaagattttgctataaacctttgatagaaaaaggctcgagcgaataataaaccgaaaaagacggaaagtaaggaggataagatagcttgtccaaaactaaataaaatgacttgtttgacgtaatcatctcgtatcagttccgcccagttataatcagtttcaacagtaaaaataccgctcaagaccgaaacataaaacaaaataataaataaccacactgccaatccacttaatgagctgattggtaatgtggaaaaataacgccatgcttttaacaaattacttcaccaaacttgcttgccattgattaatccatttttttagttgctcagcagaaatattggaactgtcaaacacatttgttttgagctgatactgttttaaggcatcataatgtggctcaatagggtcagaaatcacagataacatcacattatttttaacgatatgtgtctgtgcttgcggtgaaatcaagtaatccataaataaatcgccacaggcattttctttgtttgctattttggctgctaattcaacttgtaaaacgccgccttcagcaaaatccgtcgcttggtactgatctttttgttcatttaataaatgataaagtggagaggtgctataacttaatactaaatccgcttcaccttttaaaaatgccccataactttccgtccaacctttaccgacagtaacagtatgtttagctaatgtctgccaagctcgatctacctcttgttgcggatacactaaatttaaccaaatgattaatccccgtcccacactgcttgttcgaggatcctgataaataactcgtaaatcctgacgttcaaccagctcttgcaaagattgcggtggatttactaatttagttttatcataaataaaagcataatgcccgaaatcataaggtaaaaaacgtcgatcttgccaagaaatcggtaaagaaagtctatttaaatcaactttatgctcactaaataattcagacttaattgcctcttgtaataaatgattacttaagcctagtacaatatccgctttggttttcttaccttctaaacgcagacgattgaacaatacacctgaactgtcaaaggacacataatttacccgacattgcggatattgttgctcaaatccttgtttcacctttggacctgctccccaatcggaggaaaaacttttataagtataaacggttaagccttgtgccgatttcgcttccgcttgagcaaaagagcaaatagacatcgcagaaagtgcggtaaaaattagagtggttttgaagttcattacttttctcctgtttgaataaacacagcatgataagtaatattgacttgattggaaaaagaaaggagtaagaccattagtttcctacgtcagtattaactgtatcaggttcacgggtattatctcagctgttatcagcatcccgactaagtcggacaatagtctattatatttttgttgaaaataacaaggaattttctcttaatctttgacttaacttcaagaacttattatatctaatgtaatgtacaatttttttatcaaacattttccggcacaatacaacgctacactttttcaagaaattcaaaaaaataaacataatcaaaaaactcaacttgagcaagttatagattatgtttatcagatttgtcgttttgcttgctcatatacaaaaaccgaacaccatcctcttattaaaagtgaatttagaattttaagcaaaacaaaaacgttcccaattagtaggcaggaagagtttcaagcctgtctaaaaagaaacgttttgaagttatgtctgattaaaagaaattatttaatcaattattttttttgtagttgaccacattaaagaaacgttttccttcttgttttccggcatagccacttttttgccaaaaggcatttttcaaccaattctcaaactgctgatgagttgggaatgtcatttcaccaaaattcggatcaaagaaagtcacttttgagccgtcaaccgccgcagatacagtgtgagatcctccctcaagattaatggagattttcttaacaccggctttatcatcgcctgtatccaaaatcgcttttactaatgaggatacatcattttttgatacagttcctgatacttcatcacgacgaacaaaatccgctacttttttctctttcggaacaacaccttgctcttgcaaccaactgtctgttaatttgaattgctgagttgcactaccgctattaataaactcagtttgaagttttttaatagaatcaatagtttcttttttcaagtgtccttttttaccgccctcataaagggtattaaagaaattctcgtcgtttggattaacattttttgcaatccaatgtgcacaagttgattcacatacaccattttgtgtttccatgtgttttacaatttccttgtaaacttcccctttagattgggcaaacttaaagcttacttctccaccaaactcttcaacggaagaacgtacagcatcaattttacttttcactttcaaaggctgaaattgatcctgaatgcgttgcaataccgtgcgttgctgttcaactagctctttgttactcaccaaatcactcacaggtttcgcttttgcctgttccgtttcggtcactgtttcagaaactgtcgcagatctaactgttccggaactcaaagcagccgaattttccaccgcactttctgtcaaatccgtagaagtgcggtcagttttttctaaattctgcccgttatcttcctcgcttcctttttttgccaactcttttaaaaactcaactaccacttcactgctcgttgcggatttagttgatgctttcgtttgaggaataatctgcggttcaaactcatcactaaatttggtaaatgccggataacctgcgtcaagtaaaattttatttactatgactctcgccatacgtccattaccttctgcaaatgggtgataagcaatcaatcgctgataaactaatgccccaaccacactcggctcaattccttcatttttcgctcgattgataaaatcaaccgtttccgctaactgaatttttgccgcttcgggactagaaaataccgcattttctttggttaaattctcttttttataaagtaaacgaccttctccctcatccggacgtaatccgtgattaagattctcgatcatctgcactgtcaaaggtttgccttgactgttttgtaagaaatcctctattgcggtctttaactgttctttcaactccggtgtacgttgaatggttttcgacgtcgcagctaaagcctctgtgatttcatttgtttttgttgaaagatcctctataacctttgttttcggtaacgttttcaccaaatcttgaatttctgaaaactcctcagcagaaggacgaaatgtgattgccttattaatacgactttctactttcttagctccctcggtgagaatatcatcaaattcaggtaaatgagacatttgcttaactgtcgcttcaggaattgatttcttcgaaatctctcttgcttcatctaaaaatttctcatttttcaatacattactttcaaaattagcatttcgatcatcttctaaagaaattaatccttttaaatttaaattatcttccaagtcttgataattgactttattcgctgtctcatctcccgctacaggcttcgcaccgcccttacttccggtgaaaaattgtttcactcgttggaaaagtgtggttttttctttttctacacctgtagcaccctctgatttctctgccgcttttttatttcctcccgcagcatttttgagttctgccggtgcagatgatagcgatgcaacttcatttacagaagtctccactttcggaacagatggtaactgaccacctgctttaccttgttccggctgtttaatggtcaaactgtctgcggattgtgtgttttcgacttcactaacatctttagacttcaacgtaacaggcaaagtcgcttgttcgtcttgattattcgcaccgctctcttgagaagatgatttttttcctaattcagtcaaaaattctttcacaacttcagcacttgtcgccgacttagcggtagcttttgtttgcggaatgatctgcgtttcaaattcagaactgaatttagtaaatgccggataacctgcgtcaagtaaaattttatttactacaactcgagccatacgaccattaccttctgcgaacggatgataagcaattagtcgctgataaaccagacccgctaaaacgcttggttccacattttgcttgattgcttggttaataaagtccactgtttcatttaactgaatttttgatgcttgcggactggaaaatactgcattttctttagttaaattttcctttttgtaaagcaaacgatcgctaccttcatcaggacgtaatccatgatttaacttttcgatcatctctacagttaactctttaccctgactacttttcaaaaattcttcaatcgcaccttgaacttcttctttcaatttcggattacgttgaattgtttttgacgtatctgctaaagcttctgtaatcgctaaagtttgtgcattgagatcatctaccgcacttcctttttgtatatttttcaccaatccctgaatttcattaaattcatcaacagatggcttgaaagttaaggcatcattgatgcgtttctctactttcttcgctccctctgtcaatatttcatcaaactccggagaattccccatttgtttgattgtagcttcaggaatgtatttcttagcgatctctcttgcttctgccaaaaattcaggatttttcaacacattttcttcaaaagaagaaccacgtttatcttctaacgccaataaatttttcagatttaagtcatcttccaaactatcataattcggcttagaaacagtttcctgttcagattttgcctctttagcttgtgatttattcgatttcgcaaagaagaaatcttttactttcgcaaaccaagatttctcatctgattttgcttttggcgatacgccctctgctccttctgattggagtttatgattaccgttattgttgcgattactttcagccaacgcacttcttggtgtacctaatacagctgattgtccattttccgcaactgtttcattgcttaccggatcgctcaaatttgatgggcgtggcggtaattcaggtgccacatcatcttccactctcgcttttacaatcggatttgccgctgccgcttcatcaccttttgctttcgctctcgcaagcccttccggacttttatccaatgttgcataaatcggctcgtttacctctggttttgccgtatttgctcgatcttcttcagaatttgaccgcacttttacttcattacccagttcagttacaaccgcattttccgcaggtaatgcacgcttcggcgtttgtggctcagaagaaaattccgatggaatcggttcaaattcttcaccgctagactgactacgagccgatctcggctgtattgatggagaggtgatttcagcataatctccctccacagccaagcgttctgtacgcaccgctgtttgcgatggttcgtctaacggaattgtttcataatcactaacttgaccttttgcagctctcggttgtaacacctcagcaattgtcgcataaccatcttcaccctctgccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctctcggttgtaacggcgaaacctcaccaattgtagcgtaatctccaccatctaccgcaactttaggtgtagcctccggtgttgccggtaaatcacgttttgctttattcgctctatttacaacatcattaatgtcggcataaatatgatctgccgtatcaacttcctgagttaaacggaaatttggaagtgccggcagaggatcattcgcactgcgagttttagaggtaatttccgaataaatttcattacctacttcttccactttgtttaacaaggttttcactgtcggtaattccggcaattgatcaccagccgctcttctcacactgccgtacaacggattatccaccatttcaaggttagaagatgcttttggtttggacaatacgctgtaaatacttccaatcgtatcataaacatgatcagctaaatccgcaccttgacttaaacgagttctaaactcatttggaagaggtggtaacggatcattcgcattgcgggttctagaagtaatttccgaataagtgccattacctgcttccgtgtcgctattcaacaagtttctcactgtcggtaattccggcaattgatcactcgcagatcttctcacactgccgtacagcggattatccaccatttcaaggttagaagatgcctgcggtcgggacaaggtactgtaaatgctctcaatagtatctgctagaactttatttctcgtcccttcaccacctaaaaggctgtaaggactatcactttcaccacctaagtttctatttctaaccgcacttccattacctaaaagactgtaaggaccttcaccgatttgttcgtaaatatgctcctctgctgcttttgttcttcctaaaaggctataaggagcggctgtaatttcatcataaacatttgatctgatacgagaaatatctgaatttgcatcacctaccgtactgtaagtgctatcactttcaccgcctaaagttctatttctaaccgcacttccattacctaaaaggctgtaaggaccttcaccgatttgctcgtaaatatgttcctctgcggcttttgctcttcctaaaaggctataaggagcggctgtaatttcatcataaacatttgatctgatacgagaaatatctgaatttgcatcacctaccgtactgtaagtgctatcactttcaccgcctaaagttctatttctaaccgcacttccattacctaaaaggctgtaaggaccttcaccgatttgctcgtaaatatgttcctctgcggcttttgctcttcccaaaagactataaggagcggctgcaatttcatcataaacatttgatctgatacgagaaatatctgaatttgcatcacctaccgtactgtaaatatcatcgctattgttacgtaacgttctagctttgttagcgttgctatcgcctaaaagatcgtaagcaccttcagcactcactttgtcataaacaagctcatctcctaatgctttcacttttcctaagagactgtaaatatcatcgctaccattaggcaattttcttcctttattggcattttgatcacccaaagtgctataaccttcacttgcctcatcagaagttcttagtttgcgtacatcagcactagaaccgtagagcggattatctaccatttctacaacatcttctgaagaaattctagttgtagtcggctgttcggcatcattatttactgctttgctaaacttagattgtaatttagattttgctttttcacccaactccactaagtctgcaacttcaaaattgaattgtgtacttgcatacacatcatctctcgttacggtcttagctttgcttagatcatcaacaatttcgcccgttacattattatctttaagattgattccggaaataaccgatttttgtaccgcatcgtaatgtttttgctccgcacgcccgccacgtacattaaatgaagatgcaccacgctcgttaatacctacagaaacgccgacagaaccaccatctttatgatgactatcattaagttgttggctcgtaacatttcctgaaacacggaagccactattttcatctttattgatgaaatgagccgctacaagatccaaatctttaatttgtccggtaattctgttcgcaacaatacctgcctgttgattaagaagttttctgttctcaacttcatgagtataacctgccccaaaacttccattaccttttacaagtgtggaactagaaagtgcggcacctgctgaagcactaaaatcaaaacctctataaagtctatcgaaggaatcttgttttgatacaatgttcgttttacctttgatatttaaatccaaatgatccgctttaatatttgagctaatcaaattaagatctttacctgctgcaatttttagatttttcgctctcagcaagctgttgttatgtgtaactgatttttctgtcgtgaaactttcattgccatcaacagaacctgatacgccaccattacaacctccgctcatcacgctacaacctgaatttataccaaatgcaaatttctgacgagattgtctttcagtactttctcttgttgtttcgccgtcaagtatatcaacattacgtttggcttgaagcgttagcttgctgttagcatcgctttctacatttttcaactgtagatttccaccatgggctgaaagcgtaatattacctgcaatttttgtgcgaatgtcagaggtttccttaaccttatttgtttcgtaattacgctcaaatccaaacttagatgaaccgccaaccaattcgccggtaacaatatttgcaacatcgctaatatgttgcaacgcaactgtaccatcttgcttaacgcctcgttgtgcctctacaatttctttcgctacatggctaacagcatctgcaatagctgagtgtccttctgtttcaataccgaatttcaagactgaacgttcagaatcaagatgatattcatctttttgtttattcgatgtaatctcttttgcagaaagttcaaagccttcatcttctttaactttcttatacttgttgaataaatcattggcagatttttctgtcatcaaatcatcaacttcactttgagataggactttaaatttaggttcctctttctgagctgcgttgtctgttgcatcaggtgcggcttttgccttagcctgttgctcagctttcgcttcatcttcttctgttgcctttcctgtgaacttgtgtttattaatatcaacaccaccgatttccgcttttttcaatacatgtaaaataccatgatcgacttgcaaatcgctgttggtgtgagttaatgatgtttctttttctctcgtttcgctgaaagaaccgcccaaagtaaaaccggtgccagtattagatgatgcaccgccaatatttgttttctcgccgttttggctatcacgttcatggcttacagtgaaccctgcaccgctaatatgaccggatgaatattcttgatctaagcgaatgtaacgttccgtctgtttcgcattgcgacctgccttggtgttataatcaccttgcacaatccctgtaacaacttttgccttgatcttactgccttcctgattcacatcattttttattgcgaaatgcacatgatcaaattcggtatttgaaccgacagaaatcgctttttgcgtgctttccttacgatagcccaatacctcgcctttcttagagaaaattctacctttttcaacggaatgctcagttctgtgggtatctgtcgtattgaaattacgtgcttttacaaaacctgttttacctttaatatccgaaccttttgaattaatatctgaatcttcatctgcttcaaggtgtaaatgtccctctgttctaattgaagcacgttgaacttcaacatcgccgtttccattcacaaaagagcgagcagtattatcaattcctttgtgtccaactaagcgagtgctttcctcacttaaaatatcgcctctatttttgattttactttcggcttcaatatcaatatttttgccggaaatcgtaccgctgtttagtacatctcttgttttcaaattaatttcattagcacgaataagtgcatcaccaagtcctctgaatttttcagcatctcttaatgttttatttgcaaaataaacttgcggtaatagaacctctttattgttgatattggctttaacataccaaacaatgtcttgtttaagttgattttgttgttcttttgttagtgcttccccaactttcaaacctaactctttagattcaaaataagagttatctattaattttttaaccaactgtgcatcatttacttgatatttcaatgccaaatggttatctactttcttctcaatagattttgtaattaactgatgttctaaatagttatcaccaattaccgctactttcttaccggcatcggtagatgaacctactttatttaagaaatatttagatccaaaatattcatcttggttaatatactgcaatttcgttctgtaaagcggatcggtttccactttaggacgtgtatcatctacctcttttaagaattggtttttcgaaagtgcttcttcaatttgatgatctttcgccagctcttttctgtattcttcaagacgtttttcttcttcaattttcgcttttgcatccgcttgtttttgctgttcttgtttttctttctcaagaacgagttgtcgtttttcttcttcaattttgccttgtaatttcttctcttccgcaagtttttcggtttcttgctgagcaatttgtttcaattctgcttgtttttcaagtgcacttttctcttggcgttcttcytcytytttgtaacctgtttctagttcactttgtactttttcattttttgtttttgcatcaagagctttagcttggcgtttctgctgtgctttctctttatattcattgaatttttgacgtaacttttcctgtacatgatcaggtaaagtatcaaaacgatctcttgtttctagccttgactcagttttatagtcaggctcgtcaggctcatcgggttcgcgttcccaatcatcagacacctctcgaatatatgttttttcaccaatttcatccaataacttatctaagaattttccattctctgataattcgttttcattcaataaatcaggttcttctcctgtgtgaggttttaatagaaattcatcttcctcatcaatctcaatatttttatcgaccgttttatctaactgtacgctgttatccacaaaaagatttggaatagatagcagatctgacaaggcggataaatcaacattgctattattcagattttcttgcccgttgacctctgatttaaattccgctttactgatatcaaatttatgttgtcctactgttacttgctcagtttcagaaaatcctccagttgaaccattttctaaagctttcatatctccctgaatttttccagcaagaattttagctttatctgttgggcgataatcaaagtgggcatcttgtttttctttaaatgatttccaacgttctgacaatgttttatggtcttcatttcgccaatccgccccaaaaacttgcaccatagccttttggaaagtatccgatttaatgtcttttaataagtgcatagcttgcgagttatccgcataataagaactggaatttgttattggttgctcagaaaataaaccgtcaaaaagctcctcaagagaattgaattttctctctgcttgccctgaaagtgcggataaaaagagacgggctctcggctgataattaaatgtaatatcttgtttttgtttgaaaaattcagtcaacaaattggcttggtaagccttcatattatttacaacttttgcattttgggcttcgaaagtgtttttaacattaatcacaccatgattagtgagtgttgcctcttgttgattatctcttttcttaccttcgaatttgaaattgccttccgcacggatcaagcctgctttttcgactttcacctctgctttttcaaattctaccggattgatccatagacgatagtcgttattatgccaaccatgacttgcaatatcagaacggcgataacgggttaatacggaagaatttgttcctttgctgactttgcccgacaattgaacatcattaatcagttcattagcttttacagtaagatcgctcttagcaaaaatattacccaagttgtaaacggtattttctgcatcgagttccattttaccctcagaatgcaatagagaatccgctccattaataatatttccctcagtttctttattatttcctttagcagataaagtcagttgttcacgagcacccaaaatccctttttcattatagatactcccttgtttagcattaatcgtcagcgtttttccgctggctaataatccgttgttaacaacattgcctgccgcattaatggtaagtcttgcagtagtttgtagttcatcattttcgctaataaccacattttgagcatcaatagtcaactcatctttcgcttttataaacttgttacccttgctgacaaaacttgtattatctttaaaagttaatttagctttagatttactttcaatggtaccggtattttcaaagccaacatctaaatcagcaacggtttcttctttaacgtccgccttgcgtttattgtctttatttacagaaacagtaactgtcttacctttggttgtaatatcaagattgtcttccgcataaatttcttttttattgactaatttatcggtatcaatttttactttatttccgtaaatacgcccttggttagtcaatgtttgagatttaagctcaagatccgttgcaacgatttttgtctcgccatccaagacaagagatttttttgcatccactttaacttttttagaagctaacttccctttgttttttaacttggcatcttctgtggctgatgcctctttattattttttaacttaacatcatctgcggttattgtgatggagttatttgccgtaatctcatttgctatggtaactcttttggcgttatttaatgcaatctcatttttggcttgtaatttatcacctaaatcaatatcccctttattgctttcaattttaatatcgttttcagataaaataataccatcgtgttttacacccgcaccttgatccgttacgatcaatttaatacttttaccgtgcattgcacctgtacttgcaccggtaattgcgacttcttctttgtcggaagcctgactggtactactgtctttttgtacttctaatttcgttttaccatcattctcaatgctatatttggttttacctttccctgcaataaaggtaatttctgtttccgatgttttgaacttttctttctctttatttttaattgtgcctttctgttcaattttcttcgcaataatatctaagtaaggtaaattatccgttgcaaacccgttgacatctattgttactgttccttctgaaacatctagatccatcttgttaggatcgataagcttacttgtcgttgcaacaaaacgtcctgcgttaatggtttgcaccccatttaggttaataccatgttggttggcaataaccaaatcggcttttttacctaaaatctctaacgcccctttaatttgacttaactctgctcccgttacttgatttaaaataacttttgcttcctgctctgttaaattcttattaccttctagataacccactaattcagaacgttgttgatctttattatttttaaaaaccgctccgtttggaatattaaatttttggaaacggttatctgaaattcctttatcattcggtttcgcaatatcgataacaatgacgttattttctgttttgtatagtttagtagggtggttgtttacagttgtacctgcacctactcctatagtttgattcttagtatccaactggataccgtcattaccattttgaatatcagttagctgaggttttttctccgtttttgccgcttcctctgctgactgtgcaaaattcggtgctgctaccatacttaacagcaatacagaaacgcttttccaatttaagcacaaagcagaagataccggatttaaaaaggtttttacggataaacatacgttggataagcggtagtcttcaatcgctccctgccggtcttcctcgtctgttttttctgacacaacaacagaatcagatgaaccactatctacagctgatgtaatacattctgctacaggaactaaacaacctcttgtcttgctgaaaataagcttataacaattcttattcataataccttcctctaaactaaaaaatcaaaacgaaaccgaacctgtgaaataaaaaaccgacttcttgttactttcctcaaaagttcccactccattaataggcttagcataagtcaatgataatgcaagtgattttatttgagctttcacaccgaatgcaaaccccgcaaacgtatctacaacatggtgcggtcgttttgcatgaacttttcctatatcaatacccaaaaaagggttaatgtaagataaataactcttttgagggtaaaaagggatcgtaactgtttgagaaatatagaaaccacgatcacctgagcctgccccacctttgaatcctcttaccgtatattcatctccaattgagaactggttctctccatataagctatcaaatccatattgtgcacctaaacgaaattgataactcattcctcgattaaaaaaaacaaacggtctctgccagttaatactgcctgaaaccaatcttaatgttttgtctctatgtgaattatatgcagaatgatttgcattaaaccaccgcagtccattggaataagacagatcactataaagtttgccatgccccaaattggtcacataagataatcctatattcaatttgttattgtgatatttccctatgcgaatatcaccaaagtagctaagacgccttttaaactcaagttctccatataaagataaaatcatgtctttattacgcaataatgtgtgcgataacttaaatgacgcttgctttgtttccccactggatccgtgagtatgaattcctctcaactgtttcttataaccggaatatgataacttaatatccaaagtcgaaaatgagaaaggttgagtataagacaaggaataattttgttgccgatttgcttgacgatccttataaatacgataacccgttgaaaaactccaacggtcattcgttcctaacagatcactccatgagatgcttaatgttgcctgatttcgaccttcggcattacttccttcaccggaattattcaggcttaaactaacctgcggataagaagtgcggtgcctctcaatactcagatttgacatacttttcttgtccgatgcaatcacattgactttcgctgttttattccctgtatttaagatctcaataagctgatctacatcataaatacgaagtacttttccctttaaattgggcaataccaataacatagctttgtctttaaatagagatgcttgtttatcttccactaaaatgtcatttacttttccccaaagtacgacaaattccacttcaccgtttttgatctttgaagattttaaaccaatagcactggttacataaccggcattgtacaacacctgtgttaattcttttgtcaacgcaaacacggttttcgttgataaaggctgatttaaataatgttttatgacttcatcaaaatccagtgagatttcctctccacccaaatcaatagtaatcttcgtaattgtttgtatcgccgttgtggatttaagttgagtaactatctcctcttgatttggtcggttatcctccaaaaaacgttgtgctttttcaaaattttgctcaactttttcaaattgttgttgattttttaaatgcaataactcttgaaccaaaggcttagcctctttcgctgcttctcttgcttgcgtaaccaaaggatcttcttgtgcttgcacaactaaaggagcagcaacaaaagaaactagtaaacagcatgaaaataggatatttatcttgttatatttatattttggcataaaacgccgtccttccactttaattggaacaaattatactatacgctatttagacaactggtaataccagtataaatcattcttagcaatttcatcgtgtctttttcataatttttcataaaaaaatccccctttcctgtgctaaaaagaaaattgattatactgtagtttttatactattgaatggaatgaattacgcagtaattactttcttatttttatcttcgttttatcataactgtcattttcattaaataatactaatttcctctttaaatctctccttttttcgagtagattaagagttctcctcaaaaaattaagtaaccataaggaagaacattatgttattaactaacccagtagtaatttccattattgtgttactcgccttaagtcttatgcgaattaatgttgttatgggattagttatctcagcattagttgccgggctatgtagcgatttaaccattaatgaaacaataaaagcgttcacaggcggtttaggcgggggggctgaagttgcaatgaactatgcaattttaggtgcttttgctattgccatctctaaatcaggtattaccgatctacttgcttttaaagtaattaaacgcttaggtaaatcgccaacaggtaattcaatggctggatttaaatactttattcttgccatactagtgttattctcaatttcttcgcaaaacttattacctgtacacatcgcatttattccaattgttattcctccgctccttgcaatttttaataaactaaaagttgatcgtcgtgcggttgcttgcgtattgacatttggattgactgcaacctacatgcttctccctgtcggtttcggtaaaatttttattgatagtgttttagtgaaaaatattaatcaagtaggtgcttcactcggcttaaaaaccagtgtagcagaagtctctttggcaatggcaattccggttatcggtatggttatcggtttattaaccgcagttttcgtcacttatcgtaaacctcgagagtatgtttcagccggtttaaatgctacaactgaagaaatcgaaaagcacattgcaaatattaagcccttccatgtgattgtaagtgcggtcgcaattgtactcactttcgctttacaactgataaccagttcaacaattatcgctggtcttgtcggtctcattattttcgcagtatttggtatttttaaactaaaagaaagcaacgatattttccaacaaggcttaaaattaatggcaatgatcggtttcgtaatgattgccgcttcgggctttgctgcggtaattaatgcaactggcggtgtaacaattttggtggataatttcagccaaggcttgggtgcagaaaataaaggtttagctgcatttcttatgttgcttgtaggtctatttattaccatgggaatcggttcatccttttcaactgtaccaattattacatctatttatgtaccgctttgtctttcctttggattctcaccgttggcaactgttgcaattatcggtgtttctgccgcactgggcgatgctggctcacctgcctcagactcaactttaggtccgacatccggcttaaatatggacggtaaacatgatcatatttgggattctgttgtaccaacattcatccactacaatattccgctcattctttttggttggattgcggcaatgttcctttaataacttactttgagtgcctatggcatggcactcaaattttttaacttatgcaacaatctcctgttattatcttacttaaacaaaaagttgacgagtttttctctcgttattctcatataccttccaagcaaaaaatctatgccaaatttgaccgcactttatttagccaagactttgagagtttatcgttttacctgaaagaaattcgtcaatgtttaactcaattagaaaaaatcaatgatgataatgtacaaaaatatactttttatagtgaaaaattaaaaggacaatgtaaggctctctcagaggcgttatcacaaacaaatgctaaaacaaacatcaaatttcagcataacgatacaagtctgcaatctgtacaagagcggcgggaaaaacaaagaattgcactgaataaacttcctccaagggagcgtttaagcaaatattatgaagcattacaggctttaaacacaaaattagaacgacaacgagattgctttgaagaggctacattattacaggataagcaaacctacagccaacaaatcgcaattacacaacaacgtaaacaacggtgttctgaggctattgaacaactggaagaatatttggctttattagatacaacctcagagaaataacgaaaatataacgaaaatatttcacaagtatgcactatttttgtttaaattcttgcattaatcgcttgatctgccgatcattctttttaaatgctcgacaataaggacaaaataataaatgaatattaattgcacatttttgatagaacgctaattttttttcattactcaaagaaatcaattcagtaatttctttacaatttttcatctattttttccctccaaaccaatttttagataaacatgcctgtaactgaagtctagctcgatacaacaatacatgtaaattagacgtagaaatctcacattcctgacaaatttgttcgctatccaattccaaatactctcgcatcataaaaatgcgtgcttgctgagccggcaaccgatttaaacaagcatcaaaaacaatccaaaactcctctttgtaggtagcactttgaatatctgaccattcattaggttcaaaatggtttaaatcccaatgtcctttatcattaaaaaaagcgttcggtgcatcttcttcataaatttcagaaacgttaatcatgcggttacgactatgaattaaatcaatgattttattttttaaaatagcaaatatccacgttttcaatgctgctcgtccctcaaaagtgcggatattttttaccgcacttgttaaggcttcctgtaccacatcttcagctaaatcaagatccttcaactgcaaaacagcaaatttaaccatttgtaagcgaatttcttcaagatctgcttgagaaatatgttttgtttcactcacaatcattctccttgacaaaataatgtaagatttttcatcattctctgactatacaaattatacgctaataatataggatttaagaatgaaaaaattaacttctcacgatgttacacctgaagaaattttccaccaacgtcgtaaaattattaaagccttcggattaagtgcggtggcaactgcattaccaacgtttagttttgcacaagacagtaacagcttgaaatcccttgaatataaaaaatcgacagccacaactttaattttaacgcctgaaaataaagttaccggctataacaatttctatgaattcggtgtagataaaggatctcctgcacactatgccaaaaaatttcaagtaaacccgtggaaactggaaattggaggagaagtcgaaaatccttttacgctcaactatgatcagcttttcactcaatttccattagaagaacgtatttatcgtttccgctgcgtggaggcttgggcgatggttgtgccttggattggttttgaactcaataaattattagaaaaagcaaaaccgacaagtaaagcgaaatatgtggtatttcatactttgtatgatcccgagcaaatgccggggcaaaaaaatcatttctttgggggcggtattaattatccttatattgaggcacttaccctcgccgaagcaatgcactctctcacgttaatgtcggtaggtttgtacggaaaagcattaccaccgcaaaatggagcaccaattcgcttagttgtaccttggaaatatggctttaaaagtattaaatctattgtcaaaattactctatcggaaacacgcccacgcactacttgggaaagccttgcaccgaatgaatatggcttttatgccaatgtaaaccctaaagtagatcaccctcgttggtctcaagcctctgaacgggttattggtgccggcggattattaagtgtaaaacgccagcctacacttatgtttaatggctatgaacaggaagtggcacatttatacaagggattggatttaaggagcaattactaatgttggcattattacgcatcattattcacttgtgctgtttcgccccattggtgtggttgcttttcgtgcttttctcaggaaatgaaaccgcacttggtgccgatccgatcaaagaaattgaacatttcttaggctatacagctattttgattttctgtgctatgtttttactcagtatcctattgcaactattgaataaaaaccaataccaaattttacgccgtcctcttggtttatgggcatttgtattggcattattgcacgttgccagctatcttttcttggaattaggatttgatttctcattattcataaatgaaattataactcgtccttatctgattttaggcggcattgcttttctcattttgtcagtaatggcaataacatcgttgccccaaataaaacaatggcttggtaaacgttggtttcaaatacaccagcttgcctatatagcaattatctgtgcagcaatccattattattggtcatcaaaaagtgtaactttagcaccgattgtggtaagcctagcagtgattgggatcgttatttggaaatatagtggaaaatatctcttaacatttttgcataaaaaatagacattttattgtataaaactctcctgattttcaccgcacttttccgctaattgaatgatcatttcacacaaaaagcgacaactaagtgtcgctttctacctttaagcaaaccatcctgcttgataggcaataaataataatgtgaatgcagttaaatacactaaaccgattatagaaagccaaaataacccgcctcttatccgatgttcgccctttaatacaagcgaaagatttaaccacgcaaaaataggcgttgaaacaaaagaagcgatcatggcaaattctaacattggaccgacagcattattgaagtagaaaataatcgctaatccggaaagtgcggcaaataatatcgctaaatttaatgttcttaaactactttgttttttatttaaaattaaacgtaaacattccacatttgagcgagaatatccatcaattaccgtaattgttgtaccaaacatacacataaaagcaataaatgcaataagtgcctttgcccattcaccaatcgttgaagcatacatattaatcaattgtgcaatatattttccaccaaccatttgaaccgtttcacctgaaccaaattggactagtgcacccagtgcaagaaatacaatggctaaaattgcagtaccaatataaccgacattaaaatcccaaatgccgtcctcataagatatttttgaaatacggcgtttagcgactacccacattgaattgattgcagaaatttcaattggtgcaggcatccagcccatcaatgcaacaataaaagcaagtgcacttagactccatggatttggggcaatataatcttgcgaagcaacgccattaataccattacgcattaatgcaataattacagcagttaatgttgtcaatgttaatgcaatcataatgagtttagataaactatctagcaaacgatattgcccaaataacaaaataaataagctaacgccaataacaatcagactcaatgtaggaaccggaacagaaatcggtaatacaaaagttaaaatcgccgcacaaagcaagcctactgcggcagtattaataaccgttgaaaaaacatttaataagaaaaatacccatagataagatttccctttttggcgataaccttcaagtaacgtgttaccgctatctaaagtatattgcacaccaaaacgaaaaaatggatatttaaataaattcgctaaaagaataataatggctaattgccaaccataaatagcacctgcctgtgtcgacgcaataatatgcgaaccgccaacagccgctgaagccattaaaataccaggacccagtgcacttaatttttttgcccaaaaagattgatttacttgttgattttctttcataaaaattcctactaaccatctaacgaattaaaattctaaaatatttaaatataaaaacaagagaaaaataaaaaataaaattctaataaagaagatttataaacaaaaaataattatataaatccaaaatatttaactttactagattttaatgctattttttaaaaaataaaaagaaataaactctagaaattaagaagttagcaaacaaataaaaaacatataaaaagtaaaagcaaagaacacaatttctgtaacaagatgaaaaaccgaaaaataagatggctggggtactaggattcgaacctaggaatgccgagatcaaaacccggtgccttaccgcttggcgataccccaatagatattctaaatctgaattaactaagaagtgcttaagatagtatggctggggtactaggattcgaacctaggaatgccgagatcaaaacccggtgccttaccgcttggcgataccccaccaactaaagacttgcaagctaatgaatggtgcgggacgagggacttgaacccacacacctcgcggcgccagaacctaaatctggtgcgtctaccaatttcgccagtcccgcaaacatggtggctatgacgggattcgaacctgtgaccccaacattatgagtgttgtgctctaaccaactgagctacatagccatattatttgcattaccctcatcggctttgcggggctaattatgctgatatataccttactcgtcaactattttttaatgttttttttgatttcagtgttgttcgcatatagattatacaattcagataaaaagcatcttatgttgtttttaataaccgtttatgattgatgtcgaataatccaacaattatgaatttgtttattccgttcaaaatctaaaggtaaagttttagcagaaatttctaccgcacttaactctaattcttgcaaaccgtctatatccattttaaaacctcgtttattattggaaaaaacgatagttccatttgttcgtaggatacgctttagatttgccattaacttaatatgatcacgttgaacatcccagctatcttccattcttttagaattagaaaatgtgggaggatcaacaaaaatcaaatcgaattgacgatcacatttattcaaccactgcaaacaatccgcttgaattagtttatgctgtttaccttcaatatcatttaacaacaaattctgttctgcccaatttaaataagtatttgacatatctaccgtggttgttgattttgccaaccccaacgcagcatgaaccgttgcagatcctgtataagcaaataagttaagaaaatctttcccgacagccatttctcccagcattttacgggtcaaacgatgatctaaaaataaccctgtatccaaataatcagttaaatttacccataattttgcaccatattcatgcacataaaaatactctcccttattagcgagtttttcatattgactggtgcctttttgtttttgacgtacttttaaaattaatttattcgtttcaatacctgttaccgataaaatagcacttacagcatccaataaacgctgacgagctttattttcatcaacatttttaggtgccgcatattcttgtactataatatgatccgcatagcgatcaaccgccaaattgtattcaggtaaatcggcatcatataaacgataagcatccagtttttgttgattagcccatttatcaattttcttgatatttttacgtaaacgattagcgaaatcttgtgcaacttgtgtattttccgatacaaaagtcaatgttttttcttgcgaattttcaaccgcactttctacctgtttacgaacagcaatatggtaatttttttggacacaatctaaaggaccgttttttgccttaaattgacgatacgcacgtaaacgtaaacaatccagcaatgcaggttctccactaaaaattgaaacgttccaatctgcaaactctgtttttaattgacgaccgaatacagaatataaagcaattaaagccggagtagtgcctaatctttcaccataaggcggattacaaatcactgttcctatttcttgttcagttggatttttcaatcctgcaacatcaccttgttgccatttaatgagatgtgagacccctgcattttgagcatttttctgtgctttcttcaatactcgatgatccaaatcaaagccccaaaagtgcggtgttaattttcgattaaatgcctgctctgcaagctcaaccgcctcttgctttactttttcccatacaacttgattatgacctttccaaaaatcaaatccccaatgtaaacgatgtaattgtggtgctatctgagcttccatttgtgctgcttcaatcaataaagtaccggaaccgcacataggatcaacaagaggtgtccctttttcccaaccggagcgtaaaacaattgcagcagctaatgtttctcttaaaggtgctttccctgtatcttcacgataacctcgcagatgcaacgcctctccgctcaaatcgagagatacaactaactcatcttgatttaaataggcatgaatacgaatatcgggatactctttatccacatttggacgtgtttttccatgacgctcaaaataatctacaataccgtctttaacacgcattgcaccgaactgagtatggcgaatttctctattagtaccgttaaaatctaccaaaaaagtgactcgttcatcaaaatgagtcaaccaattttgtccaacaatagcagaatataaatctaaatcactataaatttttgttgtaataagcggtaacaaaatccgagaactcaatcttgaccataataaaatgcgatactgcgtttcatcattcgcaataaagtgaactccaccttgtacaactcgacattcttgagcaccaagatccgttaattcaacttttaaaagttcttcaaaaccacgtgacgtagtcgcaaaaagttgtttcattctatctctctataaagtaaaaattgggcgaaagcccaattaacattaatgattaaattgcgtgctatgtagctgtttataagcaccatttaaggctagtaactcttgatgagaacctcgctctttgatttcaccctgctcaatcactaatatttcatctgctttctcaatagttgataagcggtgtgcaataaccaatactgttctatctttctgcaaagtttccaaagcggcttggattgcacgttccgactctgtatctaaagcagaagttgcttcatctaaaatcaaaaccggagaatctcgtaataaggctcgagcaatagccaaacgttgacgctgtccgcctgataaactcgcaccgttctcaccaatcacggtatccaaaccattttctaatttttcgataaactccatagcataagccgcttcagccgcttcaataatttgctcacgagtacatttctctgtaactgcataagcaatattgttagcaatagtatcgttaaacaaatgaacttgctgtgaaacaaccgcacaatgttcacgtaaatttgccaaagtataatcttggatattcaccccgtctaaagtaattttaccttgttcaacatcataaaaacgagtaaccaagttggctatagtcgatttacctgaaccggatcgtcccactaatgcaacggttttaccttgcggaatagtgaaagaaatattattcaatgccggatgttcttttccactgtaactgaaagtaacattttcaaaccgcacttcccctttaactgtatctacaacatgtttccctgtatccttttcagtttcgagatctaataatgcaaataaagtctgacaagccgccattccacgctgaaattgtgcatttacgttagttaaagattttagtggtcgcatcatagcaagcattgatgaaaaaacgacagtaaatgaacccgcactgagattttgtgtcatgatttccggtagcgttgccaaaaataaaacggcagcaagtgcaaatgaggctattatttgtacaaccggatcggaaattgcactagctaccataactttcatgcctctacgacgcatattattacttacttgatcaaaacgctcttcttcaattttttgtccgccaaaagctaaaacaactttatggccttttaacatttgttctactgaagaggttaaatctcccatggagttttgtaaattttttcccaattcacgaaatttttttgacactatacgaatgataatcgcgataattggaccaataataaaaagcaccaaagccaattgccagctggtataaaacatgaccgtgagtaaagctatgatgtaagccccctcacgtacaattgtaactagcgaacctgatgaagaatttgctacttgttcactatcataaacaatacgtgacagtaacctccctaccgaattctgatcaaaaaaagtaacgggcatatacattaaatgcctaaacaatctacgacgcatcaccatcacaactttacccgaaacccaagctagacaataagttgaaatgaaattggtgaccccacgaacaaatattaacaaaaccaccacaatagccattattctcaagagcgaattgtcaactttaccaaaaccttcatccaacaccggttttaacatttggatgagtgccgcatcagctaaagcattaaataccaatgctgcagcagaagcaattaagcctaatttaaaaggtgctattgttggccatagccgtttaaatgtttgtaatgtagaaagatctttatcttgcatattcatacttctatcgtaaaaaaattgagtggcattatacatttatttaaattacaagccaattaatcctctataccaagggctaaactctgtccttgcggtttgaatttgaatatcttttcctttaaatgttaaacggatttggccggaaatggccgtattatagaccgcactttcaaccgcatttaagcgtttgacgacatcttgatgcggaaatccccacggattccaacgtccactggaaattaaagcaattttaggctgaatatgctgtagtaatttctcaccggttgacgttttactaccatgatgtccgacctgtaacacatcaatcttacccaagtcagacaaaattttatattcagtcgccacatcagcatctcctgttaataatattttatgctgtccatctgaaattatcagcacacaagaatccggattattggctctcatcacaattttacttggcgataaggcttcaatatataacccctgccaatgccatatttttcctttttgacaagcaatatgcggtctattttctggagaattctcgtacttttttaatgagggactgataaactcagcattaggataagcttggaaaatatcttttactccacctgcatgatcattatcatcatgacttaatataactttatcaagaataataccctgtcttcttagataaggaataatctcaatttttgccatactaccatttttccagcttgctcccgtatcatacaaaattccatgttgattttttaccaataaacttgccaatccttgaccaacatctagagtatcaaattgccattgtgtgttttttaatcgcccttgttcatatagcgaaaaaaaccacagacataaaaaaataacaaacatagctgaactgaccaccataccatattgatattttttatgtgaaaaaccgtccgaaaaattcaaccgtatagggtaaaaacttttttttctaacttttctcaataaagataaatcatcgtcggttgaacacttaataatccatttacagcataaggtgaagagcaaagctaatatagctgaaataaaatagctttctgcaagagaaatattgatccactgatttggtaacagctttaacaattgattgatccatatagcaagctgattagctatattccaactatttaacgcaccttccgtcagtacagcaaaaagaataagtggaactaacaaaaaactgaacaaaggcaacaataataaattagcccaaaatccatttaaggcaataccgttaaaaattaagagttggataggtgtaaaaaaccacaaaagcccaaattgcaaatgaaaaagaccgataaaataccgcacttttttcaaggaagattgtgccaaaggcttttctttccataaaaataaatttagcggtatccattgataccacatgatcaaacaacctaccgctccgattgatagccaaaaactggctgacaataacataaatggattaagtatcagtaaaacacaaataacccgcaaaaatagttgccaaacattataggaaactcgacatatacgacataaacaaactataaataaagcgacaatcgcacgaaaagtaggaattgaaaatcccgccaattctgcataacagaatgctaaaaaaagccctaatattaaaggaaaataaggttcaatataacgagtagggaataataattgaatagctcgccctaatgtaaaaccgatgaacatagctaacccaatatgcaaccctgaaattgcaattaaatgtgcggtattggtttgttgatagagttgccataattccttgtctagccatgctctttcaccaaaacccaatgcaagcaataaaccttgtgaaactaaattggaagtttgttgtaaagcttgattcagtcgagtagctcgccaagaaaaatcctcaccaattttcaccgcactttttactgtggcataagctgtaatttcttttgctaaataccaggtttgacgatcaaatcctcctatatttaatcgagaagaaatcggacgaatgtgcatatttacttgccaaatttcaccaacttgaacttcttgctcagtacgccaatttaaataaattcgctgtgttggcaaagatgaggtgaattttccttctgcgatcactgcttgatagtctttctgctgaataatttcagctattttaacgttagtttgtacttttttaggtaagcgggtaatatgctcactttgttccaacaagtttaatgcttgataatgaaaaaatcccaacccaagaacaaaaatgaaaaatagctttagaacacagcgaaaaaatactgctttaacaccaatatatcctaacccaagaacaagacataagatcaatatccattgccaattcaataaaaaaatacgaggcgaaattagcaatgtcattgcactcgctaaaataacaaaaaggtaatgatcaaggttgaatttcattgataaattgaagattaattaattcttaatctacaatatgaaaaaaatacccataaaaaccaagtcagataaacttatcttggaatacaaatcacaaaatcaacaaaataatagaaaaaaatgaagagttaacataaatttatttgcttatttgagcaacttctgatatttatagcgcctttaaaatcagctgttccattttttggagtttttgaacaatcataaccagtttgcaaagtgctttcttaagttacaatcaattgtaagccacagaatgaataattattaggagatttaaatgtctaagtcatctttaagtttattagtgctcgccggcgttgacccttataaagaaaaaaaaggcgaagaatatatgaacgatgagcaacgttctcatttcagaaaaattttgcaggcttggcaaacacaaattcaggaagagacatctcgtactgtagcacatatgcaagatgaagcttcgaactttccggatcctgctgatcgtgcaacacaggaagaagaatttagtttggagttacgtgcgagagatcgtgaacgtaaattaatgaaaaaaattgaacatacattgaaaaaattagaaacagacgatttcggttattgtgattcctgtggtgtagaaatcggtattcgtcgcttagaagctcgcccgacagcagatctttgtattgattgtaaaacgttagctgaaattcgtgaaaaacaaatgatcggttaaccaattgatcaaatttggataatgtaaaaataaattttggaaacgttttttgatagttggtttgttagcttaaaagaaattttagaacataaatcaattgttagtgttcatacgaataaagtgcggtcttctctgccgcacttttgaatttttataaaaccacaagatattaaaaaaggggtttattattttaaaatttattcaaaatctgttaagaaaaaaaaataaagtagctaaattaccaagctcaaatttgcctctaacagtttctacttcaaaacataaaactatctctcaggaaatgcgaactgagtcgccttttattgcaacaaaacagcgatcgatacacaaaaatcaacacaataaatatgttgtcaaggcgtctcaatacggaattatgccacgtatgatcagtcgtaatgcactgtcagttgtagaaaaattacatcgtaatggttatgaagcttatattgttggcggttgtttaagagatttattattaggcaaaaagccaaaagattttgatgttgcaactaatgctaaacctgagcaagttcaagctatctttcaacgacaatgtcgtttagtggggcgtcgtttccgtttagctcatattatgtttggacgtgatattattgaagtggcaacattccgtgcagcacactcggacaatcataatgaacgccaagcaaaacaaaataatgccggtatgctattgcgtgacaatgtttatggaactattgaacaagatgccgaacgccgtgattttaccgtcaatgccctttattataatccgcaaaataatacattacgtgattatttcaacggcattgaagacctcaaagccggaaagttacgtttaattggcgatccagttaaacgctaccaagaagatcctgtacgcatgcttcgttctattcgttttatggcaaaactggatatgtttttggataagcctagccaagaacctatcaaaaaaatggctcatttattaaaaaatattcctccggcaagactttttgacgaaagtgtaaaacttttacaagcgggttatggtataaaaacttatcagttgttacgtgaatatggattatttgatcaattatttcccacgcttacaccttatttcaccgataaagcggatagctttgcagaaaaaatgattattaccgctcttacctctacagatgaaagagttgccgataacttaccaattaatcctgccttcttgtttgccgctttcttctggtatccgctaagagagaaagttgaaatactcaaaaatgaaggtagtttcaataatcatgatgcttatgctctagcaagtaatgatattttagatgctttttgtaccgcacttgccgcaccacgtcgtcatacaactgtcatccgagatatttggtttctacagcttcaactgcttaaacgcaccggttctgctccgatgcgagtcatggaacatgccaaatttagggcggcatttgatctcctcgttatgcgtgcacaaatagaggggggtgaggcaattgaattggcaacttggtggcatgaatatcaacttagtaaccaagatcaacgtgaaagtttaataaaagaacaacaacgccttaatccgaaaccgaagaagaaattttatcgttcaaaaaaacatcggaaatctacgctatcatcatgaagactgtttatatcgctttaggaagtaaccttgatacgcctatacaacaactaaatctggcactaggttcattagctcaactcaaaagttgtaaattaagtgcggtgagttctttttatcaaagtaaacctcttggtccacaagatcaaccggattacgtgaatgcggttgcttgtttaaaaaccgaattagatcccatagccctattggatcaattacaacatatagaaaaccaacaaggacgagtgcggttacgtcgttggggtgaacgtactttagatttagatattttgttatatggcaatgaaattatccaaaatgaacgcttaacaattcctcattacgatatgaaaaatcgtgaatttgttatcattcctctttatgaaattgcaccacatctcattttacctcatggcgaaaaattagcggatataatgctcaatttcactcatcatcaaatgcaaaaattataaaatttaaggcaaatatcataatatttgccttatttgctgaactaattttcaacttaaacattgttgaattttttttcgaaggatttgacgtcgttgactataaattacaataagttttccactcaccattcactgcggtaccaatcacgttaaattgattatcaaagacagttaagtttgcaatcttgcccacttcaatcgaacctaatctatcatcaacgccgattgcacgagccggatataaattacacatacgtaaagtttcatctagaggaacttcaacatatttcaccatattttctaccgactctatcatagtgaccgccgcaccgcctaatgtaccattagcgtcatagcattttccatctcgcacatagattgtttttccaacaaattgaaaagattcaatattggctccggcggcagctgtcgcatcagtcacaatacaaagtttatcgcctttcaactttttatccagtttgatattttcaaaactcacatgtaaaccatcggcaataataccgctataaatatcactatctaatactgcaccaacgacacccattgcacgtccggaactaattggcgacatagcattatgtaaatgtgttgcaaaacctgctcctagttgaatagccttttttgcaacttcatagcttgcattgctgtgtcctaaagaaaccaagatcccattttttacaaactcaggaatatgttttgcggttggattttctgctgctaaagtaattttggtaatgacatccgcattatcacataagaaagatttcatctcgggcgtaatttctcgaatatattcatcacgatgcacacctttacgctcaacacttagataaggtccttctaaatgcaaacccaatgcttgattttgatatttttccaaataatctcgcatgacttgcaccgcacttttcatcccttcatcaggtgaagtgataaaagtcggaagatagcttgtcgtaccggagcgtaaattcgtttcttgcataatctctaatgtgcggacactaatatcttcattaaacattacgcccccacaaccatttaactgcaaatcaataaaaccagcggttaaattattaccttttaaatcaatacgttgaatttcattacatagctgttcttcggaaacaatggctgaaattttatcgttttcaaccactactgcatgtccgtacagcacttctttagccgtatagatcacacaatttataaaggcatatttcattttttcgtccttttaatcaagcacgctatgaatagcacgttgttccagttcagtaaaatacttaaccgtttttacttttaattcttgtgttgccggttcatcacaaacaaaaatagcatgacgatgtaattgcaatgcactaattgtccaaaaatgattaacatttccttcaacaccagcttgtaaagccaaggctttattatgtcctgttaccaacaacataacttcttccgcatctaataaagttgcaactccaatagtaagtgcatatttaggcactttagttacatcattatcaaaaaaacgagaattggcaattaatgtatcttctgttaatgtcttaattcgagtacgagaggcaagagaagatgccggctcattaaaggcaatatgcccatcaacccctacaccgcccataaataagttaatcttaccgtaagatttaattttctcttcataacggcgacattcttcatcatgatcatctgtattcccatctaaaatattaatattttgtggctgaatatcgatgtgattaaagaaattattatacataaaagaatgataactttcaggatgttctttaggtagacctacatactcatccatattaaaagttacaacatatttaaaactcacttcctccgcttgatacagtttaattaactctttatatgtctgtaatggcgttcctcccgttggtaaacctagtacaaacggacgttctgcagtaggagcgaatgtattaatacggtcaacaatatattttgcagcccatttactgacttgttgtgctgtttttaatggaattaaacgcataaaatcaccttaattatttcaatattgtcatgtacaaaatgaagtgttatttcagaaatagaataataaataaaattatacactaaatctaataataattagcctatttcttaaaatagtgatctcaatcacagataaataaccgctacatttggattgttccacattgtgaaacatattattgagcaacattaatggtgtcggtataaaggataatataaaccttttgatttaccatttttccaacgcttgttgatcggattctcgatgttcaatccaacgtgtaccttggcaagtttgttcctttttccaaaaaggggctttgctttttaaataatccataatgaattcattagcctgataagcatcacctcgatgagctgtgctgacacccactaagacaatttcatcacccgtatttaacaaaccgacacgatgcacaactgcaactcgataaagttgccaacgtttttttgcctcgacaacaatttcctgcaaggctttctctgtcattgccggataatgttccaaatataaaccggaaaccgaatcgcctaaattcatctctcttactttaccgataaaaataaccgcagcacctacgctatgaggctcggtcaaccattggtaaattgcattttgatcaaaatgttgttcttgaacggaaattttaatatctgtcatttatcctcccgtaacaggtggaaaaaatgcaatttcatctccggaacgaaccgcactttccaacggtttaagcgtttgattaatcgcaaccaatagcttccctttctctaaagctaatgcccatttatcacctttttggctgagatgttgacgtaactgctctgctgttgcaaattccgctttaacgtctaattcatcaacaccgattaactctctcgtttgtgcaaaaaataatacttttaacatctttataaattcacttcttgtctattcagcaataaaatgccctgattttccaccgctcttttcaagtaatctaacctgttcaataacaatgtctttttgtactgccttgcacatatcataaatagttaatgcagcaataccggctgctgttaatgcttccatttcaacgccggtttttccacttaatttacatatactttcaacacgaacactacttatctcaggaagtgcggtcaaatttacttcaacttttgataataacaatggatgacacaagggaataagttcccaagtacgttttgccgcttgaattccggctatacgtgcagcagcaaacacatcacctttatgatgttgccctgacaggatcatgtccaatgttgccggcgacattcgaacgaatgcttccgctcttgcttcacgaacagtatcttgtttagcagatacgtctaccatgttcgcttcaccttgatgattgatatgcgtaaatgttgtcatattttccttttatcctccaatactcgccaaatgatttcgaacaccgctatcgccaatatgtaaaaaatgatgttctcttttactttgcaatgctgtaaaaattcgactttttaactggttctgctgctcatcaaattgcaataaatctcgtagatcaattccttcttcaccaaataaacacaagtgtaattttccctttgccgaaactcttagacggttacaacttgtgcaaaaatttttttcataaggcatgatcaatccaatttcgcccttataatcaggatgtgcaaatacctttgccggtccatccgcacgttcttttttctgtatgctccacccttctcttataagtttttccgctaaaatttgacctgataaatggtattgatgaaaaaattgagccatttcgccggtttgcatcaattcaataaatcgcatttgaataggacgctctttgacccacattaaaaattgatcaaactccttatcattgagggatttcattaacactgaattcactttaattttttcataaccaatttcaaaagcacggtcaattcctcgcataatatcgtgaaatttatcaacgccggtaatcgcatgaaacattttaggatcaaggctatccacgctcacattgattgcactgattcccgcttttttccaatcctcaacttgtctagccattttgtagccattagtcgtcaatgcaatattttttattgtttcaatagcacgaatattttcaacaatggacaggaaatctttacgaagagtcggctcaccaccggtaatacgaactttttctgtacctaattgtgcaaaggcattcaccaatcgtttaatttcaaccagattcagaaaactgggttttgtgctttccgctcgatagccatgaggtaaacaatagttacaacgaaaattacacatatccgtgacagacaagcgtaaataatagtatttacgttgaaacgcatcaataagatgattttcaataacattatgaatagaaatagatctttgcactagacacctttttaaataagaaaggataagtcgtttccaatattatccctgagcaattatatttgctggcattgtttccttatttttcaacttaggtaaacaagctcggagttatgcgataacgctcgtattttaaagaaatttaactcattagcctagtcttaaatgaatgaaattaaaaaattgtaatttagtacataaatttaagtgataaacattcaccttaagcatttcaatctttataataggtgaaattttatggagagatattatggcaacaattaaagatgtggcaaaaatggcaggagtatccacaacaacggtctcccatgtcatcaataaaacacgttttgttgcaaaagaaactgaacaacaagttttgcaagcaataaaaaacctcaactactcaccaagtgcggttgccaggagtttaaaagtcaatacaacaaaatctataggaatgattgttacaacctgtgaaactccctattttgcagaaattattcattccgtggaagagctttgttatcgacaaggttattctctatttctatgcaacacgcaaaataatccggagaaaatcaaaaaccatctcgacatgctggctaaaaaacgtgttgacggcttactcgttatgtgtgctgaatatactcaaaactctcttaatctccttgccgcattcgaagatttgccgatggttgtcatggattggggaccatttaatgaaaatacggatcttatccaagataacagtttctccggtggatatattgcgaccaaatatctgattgataatggtcataaagatattgcgattatttccggagaattaaaaaaaactaccgcagtaatgcgttatcagggatttgaaaaagcaatgcaagaagcaaatctggctatcaatcctgactggatcatggagggcttctttgaaccggaagatggctatgaatgtatgaataaaattcttgtgcaagataaactgccgactgcggtcttttgttgtaacgatgttatggcattgggtgcaatttcagcaattggagaaaaaggtttgaaagtgcctgatgatatttcagttattggttatgataatattcatgcctcacgcttcttttctccccctttaacaacgatacatcaatcaaaatcccgtttaggggtacaggcaattaacctattgtttaaacggattagtgaaaaggggaaagaacatgaaattatagaaatttatcctgagcttgttattcgcaaatcagtgaaaacgctataaaatctatcttaaaataaatctccataatatttttgtaggtatttatttttttatctattatctaattgaatatgctcaaacaatttctttaccgcattattatctcttaaacgttcagcttgctcaactaatgttcgggttaagtgcggtgagaaatattgaataaaatcgtacatataatttcttaaaaaaataccatgtttaaacgctatttgtgtcatactcgatctaaataaatggcttgcatcaagtgcaactaaatcattgtcagcctcagtatgtgccattgatgccattattcctacgcctaaccctaaacggacataggttttgataacatcggcatctgtcgctgtgaaaacaatgttaggcaataaccccgcactattaaaagcatagtctaaatcagatccccctgtaaaaccaaaggtataagtcactagaggatattgaccaagtgcttcaattgtcaatttcttacattgagccaaaggatgttccggtttgacaattactgagcgattccacatataacaaggcaataaaacaacgtcatcaaaaagatattgtgcttctgttgtaattgcaaaatcaacctcaccgaataaaagagcgtcataaatttgcgtaggagaaccttgatgaatatgtaaacttacttccggatattgtttagaaaaacgtctaatgacggaaggtaacatataacgagcctgcgtatttgttgtcgcaatacgtaaaactccacaatttggacgagtatattcattggcaattgctttaatattttgtgttttgactaataattcccttgccacggcgacaattcttgcccctgccggtgttaggcctttaatatgtttaccattgcgttcaaaaatctctaaacccaactcatcttctaacaacctaacttgtttactgataccgggctgagaagtaaacaatgcgttagccgcatcagtaacattcatattttgattaacaatttcaacaatataacgaaattgctgaattttcatagcaatacctaaaatctcaatgagaaaaaaggtgtgtcaaaacacaccttcgataaaaaatttattgtggataacgagctgcgacttcagataatagaggttgcaactctccctgttgaaacatttctagcattatatcacaaccaccaattaattccccctctacccacaattgcggaaaagtaggccaattagcataattcggtaatgccgctcgaatatccggatgttgtaaaatatcaacataaccaaaagggacattacaattaattaatacttcaaccgctcttgcagaaaatccacacgacgggaatttaggcgatcctttcatataaataagaattggattctcactgatttgttttttaattttgtctaaagtttccataatatctcttataaggtaaattcgggctgaattgtagcataatacaataaagccctaaataaatatttagggcttataaaatctactaaaggataacgatattatttgctacctttcactgagatttcaacacgacgatcttctgctaaacaggcgattaatgctttgcgacctttaaccgcatcacatttcataccagtcaccggatttgcttcaccgtaaccaaccgcactaatggcatcttgagcaacacctttagagactaaataatttgctacagtatccgcacgacgttgtgataattttaagtttgacgcatcagaaccgatacggtctgtataaccggcaacagaaacttgtgcagtttttaattgtgcgatttcaccataaacaccgtccaatgtttgttgagcttcaggttttaatgtatctttagcgaaggcaaaattcacatctgaatttaagctgaacactttgtttactacttcaggtgccataaccggtttttgaccgaaacggtaagataagccaagtgttactgcaccgatacttggtgtataatctaagcgttcaccatcattcttaagtgctttaccaacgcctttaacccattgatattccaaacgtaatgccaattccggtaaagaaggtaggctgtattcaacacccgctgcgaaaaccggagaaacttttaaagtgttttttacaccgtctgctgaattttcgaatttttcaacattaagataattagaacgaattaacgccgcacctacacgaccgtaaatatccaagccttctaatacagggtagctggcttttaagcctaattgcatcccttgagcggtatgtttagcttcgtctttatctttacgaccttttgcttgaccgaaatactcagaacccaactctacagcgacatgatcggtaatttggtaaccaccaaaaataccataagctactgaattacgaactgttccttccttttctgcagaattttcaaattgattaagaccgtcatggaaagatgcccaaccggctttcgcaccggcatagaacgtatttgcttgaggtgccgcttgcacagaagcaacaaaacctgcgatagataatgcaataattgtttttttcatttgaatttcctctatattaattatcaagaaattaagcactacatgtattccgaagatttaaacatctctaggaattaaggtgggattttaacctaattttacaaaaaagataaattttttctctgatttatcttattaaagactaaaatttaagcaggttttccattttttttgctttaactaagaattcttttctttcatgacttgccatttgattacttgttcccggtaatttcactgttaacgggttaacaggtctaccgttaatatgaaattcgtaatgtaaatgagcaccggttgaacgtccggtatttcccgataatgctatacgttgtcctctttttaccgattgccccggtttgactaatgagcgacttaaatgcatatagactgtctgatattctttgccatgtctaatcatcatataacgtccggcaccgttagcctgataagcgactttctctactactccatctgccggagcgatgatagtcgtgcctacaggtacagcaaaatcaacccctttgtgcggtcgtatttttcctgtaacgggatgacggcgagcaagattaaaaggagaagacaccctagcttgacgtaataaaggataacgtgcgaaacctttccctaaagtttctccctgacgactataatagcgtccattatttgcttggattgcgtaataactttttccaccggacataatatgtatggcttcgaccttgccttgcccagtcaatttattatctaagtactctctcgaaactaaaatggcaaacttatcccctttttttaacttattaagacttacctgccactgaagtgcggtagttaattgagcaatttgtttactgctcaagcccaaggctttcaaactggcataaaatgatccttctatctgtccttttagaacctcttctttccaaacacttttcttttctaaaatttgacgtttaaactgagattcattaactcgctcataaatacgttcttcacgttcggaaacaagccaatttaaatattccaaatttccatcattatccaatatccaataaatttgttggccagctttcagattttttaattccggataactcgccatcatttgacgactgatttcctcatccaaccctgaatgttccaatacatctttcaatttatcgccacgaacaactgtatgtgcaaattgatctttaatacgcattgcttgatctgcagcatctaataaactatttaaggcatctttggcattatcgggcaatgatgacatttcatcatccaaattaacctgatccgcttcatcatccaaaccgtctaaatcatcataagacaattcactgttatttttttcatttgcaattggcatatcaacggatgtaggcttctgagaagaaacatcgtttctcaagaacaaccctatacccattaaaataaataaaatagctacaaaaaaaacggcaacttttatgtagaatttctttttgcgtctatctctagctaatttaatgtgctgcaccattctaataacaactctataaaatttcagaacttcaataagaccgagaattgtactaaaaattcatttcatttcataaaaaaaattatacacccgcataatttatagacataaataattactacaccttgttaaaataaaaaaaataagctatttttctacttcaattttacctcagacatttgtttattatgcaaattcactctctaaaatatccattaatcgaattaaaaggcgttaatgtaacattcgcacaaaagaatattctaagcgatattaatttaacgatttatcccaattccattatgaccattgtaggaccgaatggaggcggaaaatcaacattactcaaagtactattaaaactgttacccgccacaagcggtgaagttatttatagcaaaaatgtcgttatcggttatgttccacaaaacatttatttggacaaaagtttgcctattaccgtagaaaaatttttatctttaagaaaagggacgcataaacaagatataaaagatgcgttaacattactttccattggacatttacgtttgaacgctatgcaaaaactatctggcggcgaaatgcaacgtgttttgctggctagggctattttgaataagcctaatttacttgtattggatgaacctactcaaggagtagatataacaggacaagcagaactttatcaactgataaagcaaactcaacaacaactcaattgtgccattctcatggtttcccatgatctacatcttgtcatggcagacacaaacgaagttctttgcgttaatcaacacatctgctgtgcaggctctcctgaggcagtatccaatgatcctgtttttattcgtttctttggcaatcaattcgcaaaaaatatcgctttctatactcatcaccataatcataaacataatattcatggtgatatttgttgtggtcaagatttccggtctacacaatgtaaacacaaaataaattaaggaataaaaatgcttgaaattctctttcctgcttggctaaccggaatattactctcattaattaccgcacctttaggctctttcgttgtttggaggaagatggcttatttcggtgatacattggcacactctgccttacttggtgttaccttaggcatttttttacacatcaatccatatgttgctattctaatattaaccgtattattagcgatcttaatggtttggctggaaagtaatacgcaatattccatagatacattattaggtattattgcacatagttgcttatctcttggagttgttaccgttgctttactgcaaaatgttcgtgtagatttaatggcttacttgtttggagatttattggcactgggatttgatgatctctattttattgccatcggagtaagcatcgtattaggaattttaatctttttttggcaacctttattatcaattaccgtcagtcctgaacttgctcaagttgaaggcattaatatcaaaagaatgcagtttctattaatgattttaaccgcacttaccattgcattaagtatgaaatttgtaggtgctttaattattacttcattactgattattccggcggcaacggcaaaacgttttgcaagaagtccggaaatgatggtgattattgctatttttgtgagtatgatttccatcacattaggattaacattatcagcattctatgatacgccttccggtccttccgttgttattagctctacgttcttatttattctttctttatttaaaaaagaaaataattaggtaaattacaataaaaagacgcaaggtaaccaaaataccttacgcctttctttttattattgaaaaattaacttatttccagagagtaggatcaacgcctttacgaagtaattgagggtattgttcaattttaaattcaggatctttacccgctttgagctgttggcggtaatcttttagcaacaacataactatcggtgccaataaaacaatagacacaaggttaattaatgccataatcgccatcaccgtatctgcaaagttccatacaatatttcctgaattgactgcaccaaaatacacaaagaacaacacaattaaacggaaagtgagaataaacaatggtttattgcgaataaaacgaatgttactttctgcataagcgtagtttccgataatagaagaaaatgcaaataacaataggataaaagctaagaaatgtaagccaaattcaccgacatggtactgtaaagcatattgggttaatgaaatgtttttcagttgttcgccaccataattatctgacaataaaataatcaccgcagtacaagtacacacaataatggtatctacaaacacaccaagcatttgaatcaacccttgacttaccggatgtttgacatctgccgatgctgccgcatttggtgcagaccccatacctgcctcattagagaaaagtcctcgtttaattcccattaacatagctttagaaaaaattgcaccgaacataccaccagccattgcgtcaaaattaaaagcactttgaataatacggcttatcactgtcggtaccatttcaatattcatacctaaaataatcaccgcaacaatgagataaaataacgccatcataggaacaatctgagcagaaactttaccaatacgtttcactccaccaaaaataattaaccccgttacgataacgagagttaacccgacatagtgcggttgccatttccaagcattttttgttgcctcaacaatggcattggattgaactgcattaaacgcaaatccgaacgtaaatattaaagcaattgcaaaacatgctgccaaccaaggagctttcaatcctcttgtaatataataggcaggtccgccacgaaataacccgtttttatctttaactttaaataactgagccaaagaagattcagcaaatgcactggacattccaatcaacgccgttacccacatccaaaagacagcaccttccccgccaagtgctattgccgttgcaacgcctccgatattacccacacctacacggctggctaaaccagtagtaaatgcctgaaatggcgttaaagattgtccttgaactgcccgtccaaaccacatttcacgcaaactttgtggaaataaacgcaattgaataaagccggttgctaacgtaaaaaacgcacctacaccaagtaatgtaatagtcgctaaatcccatagtggtccatcaaatttatcaacaaaccaacttagtgcttgttcaatgtttattattatagttgaaaacataatctacctcccattaaattgaaacgtgagtatttaaatacaaatttaaaaaaaacaaaaacaaaaataattaaaatataaaacaaatactcttcaattagaaaaaatctaatattaaagcgtttaattaaataaaaaacaataaaaggaggttctacttttgaaaaaatactaatctcgtgataaaaagagtgccgccgcacctcgtacaccgccggaatcaccaaattttgcttttttaattaacggtactttcgctgtacgcattaaatgctgcggtaatgctttaggtaatgcttcatataaataatcaaagttggacaagcctcctcctaagataatcacatgcggatcaagtgcggtaataatattgccaattgaaatcgcacacagctcaataaaaagttcaacaaatttaaccgcactttcgtctttgtcataaaagcaccgaataatttctttagcggataacgcctttccttgtagatcacgatacaacatttcaaaaccacgaccggataagtaagtatccaagcatgctttattgccacaaccgcattcataaataggtgctttatcccaacctaacaatttcaaggcgtgataattaagttgcaaatgccccaattcgcccgccataccgctttgcccggaatggactttgccgttaaataccaaaccgccgccaaaaccggtacctagaatcaaacctaatacgacaggatattgctggttatctttatcccaagcctctgacaaggcaaagcaatttgcatcattttccgcccgcacttctctacctaaacgctcagatagatcttttaaaataggtttattgtcagcaacacgaatatttgtaatctctgcaataccggtttcctgattaacaaatccgggaacgccgatgccaactgtacctttacaggcaaatttttcatcggctttttgcactaaatgggtaatgacatttaaccattcatcataactgtctttgggtgtatccactctttcggaataacgtttctccaatttttcattaaatacagcaagctcaatttttgtgccaccaatatcaaatccgtaatacataaatcctccaaatataaccaataccaaccgcacttttatatcttgtcaaaaacaaaaatatcttttctttgtaaataagcaaatataatcaaatgcacaaaccaagcgattaaaatagaagccaatagatcaataggataatgcatacctaagcgtaatcgactcaccaacattaacaccgcccacacagttacaacaggtactaacaatttaattttagggttgcgatgaccaagtaattgtgcaaatccaacaactaatagcaaccaagttgccgcaaacattgtatgtccggaagggaaagaataacctgtttcattagcatgatgttcgatcagccaatcaggtgcggtctgttttgtctttgtttcttgataatattgatacaccatttttttccgctcatggcgtttttgtgcataaaaatcatctgtactcatgtctgaattctgcactatttcttgcacaaaaggacgaggttcagaaaacattgtttttaaaccgctcttaatgccttgagtcaaaataactgaacatgccataatcacaattgcccatattgcctgttttttatcccgaattgcaacgaaataaaataaagcaaatgcaatacaagtgataattgcataaggtgtgctacccgtttctgttaaaaaatataaaaaataatcaagcgaggcaacttcattagattgccagtgccaatcaatgaagtaagtaaaaattggtacaacgcaaagtaataaagtatataatgaaaaacgttttaacatcttgataactcataaaatgaacttacataaggctcttacattttaacattatcaagttataaaaagctaaaaataagtataggtattttattatgtccaaaattcagttagttgctgaagctaaattacccaccgagttcggaattttccgtattgtcggctttgagtttccagatactcaaaaagaacatgttgctcttgtaatgggcaatattaatgatgataaacctgttcttgcacgtatccattcagaatgtttaaccggcgacgctttacatagcttaaaatgtgattgcggtttccaactggcgaccgcattacgccaaatcagcgaagcaggacgaggagtattgatttatcatcgtgaagaagggcgtggtattggactaattaataaaattcgagcttacgctttgcaagatcaaggattggatacgattgaggcgaaccttgctttaggttttgctgctgatgaacgcaacttttcggtttgtgccgacatttttgcattactgggggtgaaacaagtacgtctgctcacaaataatccgaataaaattgaaaccatgaaaaaatccggtatcaatattgtggagcgagtgccattgaatgtaggtgaaaaccgctataacacagaatatctagatacgaaagcaaaaaaaatgggacactttattgtgcataataatgaaccacatttaatcacttgtccgcattgccaagaagaaattccgaaaaaataattttcataggttggcattccccaacctatatttttaactaagttgtccaataatttatttttctatttaatctttctcacttaattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagataaagaaaagacaacgaataccgctgcctttgcttatatgattatgaataatattttgagggctgaagtcgattagacctaaatttcacaccattttcgcaaggttttaagctaccttttaagtattccaatgttaaactcgctcatggtgaaattcactcacatcaggggcatcatagatgcggtaagtatctttataactccagtagtccctcgctctcttttccctttgcgatgaccgccaaaatagctttcatctaactcaatgtttccctcaaaaatttcatcggtttcaagagataaatggtgatcctgacttcgagtatattcgaaactgaacgagcagtcacttctagcacaaaaactcaagtaatcttttttatatcatttccctttatttttttccttaaattcctgtttataaaaaatgcgagacagatcactaatttaacatctggttgttttctatacctatttcctgtgttataaacgtatttcctttatccaattattcctagaaaatccatagtaaaggtagcagaataannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatataaagcacatgagtcgtttttgcctgacgtaaatattcctcttaaattacaaaaaggctataaatacgtgtttgaatatatccctccagatgcaagtttaaaagagcaaacatggtcattagagatagagggaataagttttaataaagaatatgaaagtcatctaaaaaacttaatgttaaatgatggtattgaacatataagtaaaattaaagaggggtatctttatccagcaccagtaataaaaactagagtaaaaaatctagaaacagatgaagtgtatgagaatgtattatcttttcaaaacaagaactccagccatgtatgcaatgaaaccctacaaaatatttggtgttatcattatagagctgatgtactcacaggacaacgttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttaattctgtgttaaaatccattttgcatttttaacccgatacaacggttacgaacaaatataggtaagataatgctccctagattaaaagatattcctcaacttgatcctttagtttctgcctatttggaaaaattaaaaacgcaacattttgaaggtgatatagcgacaaattatgcagaacgtttaagtttagcaaccgataacagtgtttatcaacaacttccacaagctattttatttcctaaaacaacaaacgatgtggtatgccttacaaagctggctcaacaaaaaaatttccaatctcttacctttacgccaagaggcggcggtacaggaaccaatggtcaagcaattaaccataatatcatcgttgatctttctcgttatatgacaaagatcttggaactcaatgtggagcaacggtgggttcgtgtacaagccggtgttgttaaagatcagctcaatcaatttttaaaaccctacgggttgtttttttcaccggaactttctaccagtaatcgagctactattggcggaatgattaatactgatgcttccggacaaggctctctaaaatatggtaaaacttcagatcatgtactagcgctaaaatctgtcttaatgaatggagaaattttagaaacaagtgcggtcaaatctgatgaacttttacaaaatattcagcatttatcatcaacaggacaaaaacttcatcaagaaatctttcaacgctgtcaacaaaaacgctcacaaattctcactgatttgcctcaattaaaccgttttttaaccggctatgatttaaaaaatgtatttaccgaagatcaaagcgaatttaatcttagtcgtattttaaccggatctgaaggttcattagcttttatttgcgaagcggttttagacttaaaacctattcctcaataccgcactttaatcaacatcaaatatagctctttcgatgcagcattacgcaatgcacctttcatgctggcggttgaagcattatccgttgaaaccattgatagcaaagtactgaatctagccaaacaagatattatttggcattctgtacatgaattacttacggaagaaaaagaaaacccaattttaggtttaaatatcgttgaatatgcaggaaacgacctcaccttaattcaaaaacaagtatctcacttatgccaactgttagacgataaaatagctcaacaacaagataacattatcggttatcaagtttgctcagatcttccttccatcgaacgaatttatgctatgcgaaaaaaagcggtgggcttattaggtaatagcaaaggcaataaaaaacctattccttttgtggaagacagttgcgtaccgcctgaaaatctagccaactatattagtgagtttcgtcaattattagataaacatcacctagattacggtatgtttggacatgtcgatgcaggtgttctacatgtacgccccgctttagatttatgtaataaagaacaagttttgctattcaaaactatttctgatcaagtagcagatttaacaaaaaaatatggtggcttaatttggggagaacatggaaaaggaatgcgttcacaatacggtgaaaaattctttactccggaattatggcaagaattacgctacattaaatttttattcgatccgaataatcgtttaaatccgggtaaaatttgtaccgcactttattctgaacaagaactctactccattttgtcgccaatgcgagcagatcaagatcgtcaaattcccattcaaatgcgagaggaattttccggtgcgatgaattgtaatggtaacggattatgctttaactttgatgttcacagtgccatgtgtccgtctatgaaagtcagcaaaaaccggctattttcgcccaaagggcgtgcagcaataattcgtgaatggttgcgtttgatggcaaatgaaaatatctcgcctgaacagctgaattttcgtaaagtcgaagtgaaattaacagatcttgtcaaaaaaattcgcaatacggttgcccaaaaacaaggggaatacgatttttctcacgaagttaaagaggctatgaatacttgtttagcctgtaaggcttgtgctacgcaatgtccaattaaaattgatgtgcccagctttcgtgccaagtttttctatttttaccataaccgctatttacgcccattgaaagattatgtggttgcaaatgtagaaatgatggcacctttaatggcaaaagcaccgaaatttttcaacttttttacaacggctaaactcactcaatctttggctgaaaatctgctagggatgactgatttaccctcattgtctgttccctctttgcaacaacagttagttgaaataaattatcaaggttattcattggagcaactggaaaatctaagtgcggtagaaaaacaaaatattttattgattgttcaagatccgtttacctctttttacgatgcaaaagtcgtcgccgattttgtagcactctgtcaaaaattaggttacaaagcgattgttcttccttttaaacctaatggtaaagcaatgcatataaaaggattcctagcacgttttgccaaaactgcaaaaaatcaagcggacttcctcaataagataagtaaactcggtttatctctggtcggtgttgatcctgccattgttctttcttatcgtgatgaatataaagaaattctcggtgatgaaagaggagattttaatgttatcactgctcatgagtggttgaaacaagaattaagttcagggaaacttgagcataaacttacacaaattatgcaaaaaaataactgcacttttaataaagaaagtcaacaaaaatggtatttatttccacattgtacggaaagtactacactaccgaacagtgcaaaagaatggcagcaaattttttcagcttttggacaagaattacaaacaaaaaatgttggttgttgcggtatggcgggaacgtttgggcatgaaattcagcacctagagatgtcaaaagaaatttaccatttatcctgggctaaaaaattacaaggaaaaaatcctgattattgtttagctacggggtattcttgtcgcagtcaagttaaacgtatgctccattggcaacctaagcatcctattcaagccctattatcaattatttaaatagaaagaacttgttatgaaaatttggaaaaaaaactacacattagaccagcttaaccaattaaccgccaattgtgccgttgcacatttaggtatagaattcactgctcaaggtgatgattggcttgaagcaactctccccatagatcatagaacaactcaacctatgggatatttacacggcggtatatcctgtgcattagccgaaacagtagggtcagcggcaggtttttgttgtgttgatgaaaatcaagcggtacttggtgcagaaatcaatgcaagccatttacgccctgctacaagaggaaaagttacggcgagagcaacaccaattcggataggaaaaaatattcacgtttggcaaatcaatctttacgatgaagaacggaaaatttgttgtagctcaagactaacattaagtgtgatagcaattaattaacaattaaataacgttgctcgttggctattaacaccaatccacaacgcatgatttaccattgacatcacaagataataatttaggaagttatatagtgaaaaaagacaataaaatactcggcgtagtgctaggcatagggcttattttagtggggatatttatattaaacagtcccttattgactttattgacaattatttcgtaccttgcatgggcagttttgctcagggggttattttccctctttaaatgttataaatcacataaaaatacccaaccatttgataaaacagaattagccgctggcatcgtcttaatgattcttggcgtgatattcttaaccaacccttcatttaccaatacacttgtattttatttagtcgccttttggtttatatttgaggggattgtcggtatatattatgccgccaaacaaaaagatgcagcaaaatgggtaggcattgtgctggggatttttctcgtattttttggcttatccatttcagtagaacctctcagagctatattggcactcaatctattgttgggattggcagtagtaaccaacgggattcaactcctaaccgttcaactgatgaaagagaaatagagggccaccgaatgaaaaaaatcggtattattcttgccaatttaggtacacccgatgaacctactcctaaagcattatctcgctatttatggcaatttttgactgatccacgtgtagtggatctacctaaatggcgttggtatccgttacttaaaagcattattttgcctcgccgatcagctcgggtcgccaaaatatatcaaaccgtttggacagataaaggttctcctttacttgtcatttccaatcagcaaaagcaagcgttacaatcccacttcgatgaacaccgtattaatgcaacagtagaaattgcaatgacgtatggaaacccgtcaatggaaagtgcggttgaaaaactattgaaaaagcatgtgaatgaaatcatcttgttaccccttttcccacaatatagcagtacaactaccggtgctgtctttgatgcttttgcacaggcattaaaaaaacaacgcaacattgtgccttttcagtttattcattcataccatttacatgaagattatatcgaggcactggtaaatagtattaacactaaacacaaaccggatgaatacttaattttttcttttcatggcataccgttacgctatgaaaatgaaggagattattatcgtaaacattgtcatgaaacagttttagctgtagtagaacgtttaggcttgcgtgaaaatcagtggcaaatgacgttccaatcaagattcggaaaagaagaatggttgcaaccttatacggataaagtgttggaaaatatttatcaacgaaatatacaaaaagttgccgtggtttgtcccggattttccgcagattgtttagaaacaatcgaagaaattaatgaagaaaatcgaagaatttttctctctcatgggggagcgtcttttcaatatattcccgcacttaatgcagaaatgcaacatattgaaatgatgtataaattaatctcaagtagattataaaatcaactggtaaaatagagctgtaaaatactctatttacatctaaaaacattaatcttaaaatgccccgtcatcgcataccactgtcagttaaatttgctgatttatctttctaactctcaacgaattaaaggaaattgagatgaaaaaattgactaaaatgactttagctaatctgattttactcggagcgattcaaacagcgaatgccagtgataatactgtgtatctttatacatggagtgaatatgtccctgaaggattattagaaaactttactaaggaaacaggcattaaagttattgcatccagtttagaatccaatgaaacaatgtatgccaagctaaaaacgttggggaaaaacagtggatatgatgttattgcaccgaccagctattttgtgtctaaaatggcaagagaaggtatgttaaaggaattagatcacagtaaacttcctgtaatacaggaacttgatcctaatatgttagatagaccttttgacaaaggtaataaatactctcttccacaactattcggtgcaaccggtattggatacaacgctgacaatcaaaatccggaacaccttcaatcttggggtgatttatggaaccctgaatttgcaaataaactgcaaatgctggatgacccaagagaactatttaatattgcattactaaaaatgggggaaaatccaaatacccaagatccaaaggtaatagaaaaagcctatcaagaattattaaagctacgtcctaatattttagtttttaactctgataatcccgcaaatacctttattaccggtgaaacagatgtcggcttgatttggaacggatctattcgtgtcgcacaaaatgcaggcgtaccgattaaaattgtttatccaaaagaaggaaccatgttgtggattgataatttagccattccagcaacagctaaaaatgttgaatcggcatacaaactcatcaattacctgttaagtgcggatgtttccgaaaaattaacgctcgaaataggctatcctacttcaaatctcaacgctctcgaacgcttgccaaaagaattaaccgaaaataaaggtatcttcttaccgcaagaagtgcttgatcgaagtcaatggcaagtagatgtaggagaggcggctgaactttatgaaacttattatcaaaaattaaaaaatatgcaataaatacttccccgaaaagaactcatgaatgatccccgtaaactgcggggattttatttatcagataaactatttttaaatatttttactcaccaacttaaatgaagtttaattcgctttatattcttcaatcacaacaggtaaagtcaaggttttatctaaacgctgtatgaccatatttattgtggtattaggtttagtattactaatcgcttccatcatttgagcaggagaaacagcatcaataccatcaaaactaacaatcacatcaccaggctgaataccggctttatgtgcagggctaccttgtaatattgatgtaattaaaattcctttatctcttaaaccctttccattgctaaatagaatatcactttgcacccctaagtaaccacgaataactcgaccatcacgaatgattttttgcataacatcattagctaattcaataggaatggcaaaatttaatccttccgaaatttcgttggcattcttaccaatacttaacgtacttataccaatcaattcaccagcagaattaatgagtgccccaccggaattaccacgattaagagaggcatccgtttgaataaaattttgtcgtccaatgaaatcgccaacagcattacgacccaatgcactaataataccttgcgacacactttgacctaggttatagggattcccaatagataaaacgacatcaccgacatgagcttgacgttttggattttgtggaatggttgccagattatctgcatgaatttttaaaaccgctaaatctgtcaagcgatccgaccccactaacttcgcttcaaaaatacgtccattttgtaatgccaccacaatttgatccgcattttgaacaacatgctcattagtcaatatataaccatcttttgacataataacgccggatcccaagttattaatttgtggctggtaattattggttgtaaatgcaaaagcttgattataaacattaactaccgccggtgaagcaatacgtacagcatctttataagaaagaatatctttttgtataaaaaaaatatttgtcaaatacccatttcccttgaaaacaagcaatataagtaacaccaatgctgcggcagctaacccagtgattattgattgaattaatttttttatcattatgtgattgccctcagtatcataaaatgtgacgctgataattcaacttaatgtcttcgccaatttgtgccaaagataacaattgccactttggtgcatcggctaaacgcttcaaatgtggcaaatggcaaaaaccacgagctttattacccagtaatttcggtgccatataaataatgagctcattcactaaattttcctcaataaatgcaccggctaaagtttctcccgcttctaaccaaagactattaatctgacgcgttgccaattcaatcaacaagttttccaaataagaatgctcgttacttgggaataattttatatattgacaataatcaggaaacgctgacatatcacgctctttatcacccaccagccaaacgggagattgacattgaaataatttatgacgaggtgtcacaagatgctgacgatcaagaataattctgacaggttgacgcacatcttcaactttataattttgttgtaattccgatggaaattgctcccaacgaagatttaacaagggatcatcggctaacaccgtcttagctgtcgataaaattgcagaaactttagcccgctcttgctgtacgtcttgccgtgcctgttctccgctaatccatttactctcgccattagccatagcagttcgaccgtcaaggcttattgccattttcaaaataacaaaaggtttctgtgttctcattcgtgttaaaaaacctttgtttaataattccgctttttcttgtaataatcctaccgcactttcaatacctgctgcttgcaacatagctaaccctttgcctgcaacttgcggattaggatctttcattgccacaataacgttgcgaatacctgcttcaattagtccttttgcacaaggaggcgttcttccgaaatgagaacaaggctctaaagtcacataagcagttgccccctttgctctatcaccggcatcacgtaatgccataacttccgcatggggttgccccgctttaaaatgaaaacctctcccaacaatttcaccatttttgactaaaacacagcccacagcaggattaggtgttgtggtaaatatgccttttttcgcaagatctaaagctatctgcataaaatattcgtcttgagctgaaaatgttggttgcatcactaatcctttaatttttcaatttcattggtaaattgattaatatcatcaaaactcaaataaaccgaggcaaaacgaatataagcaactttatccaattctttcaattcagccatcactaaacgcccaacatcttgacttttcacatcacgctcacctgttgctcgtaattgataaataatgcgactaattgctttctctacatcatcagaactcacaggtcgtttttctaaagcatgttgaatacctcgacgcaatttatcttcatcaaaaggttcacgtgagccatcatttttgataattttaggcacaataacttccgcactttcaaaggtcgtgaaccgctcatgacaatatccacattctctacggcgacgaacctgataaccatcagaaaccaagcgactatcaatcacctttgtctcctccattgcacaaaaaggacatcgcataaaaaatccttaattaatcaaaaaaaaataaagcttatcttagcaaaatagacgtaacttgacgatatatttacatatcagtcaacaacgaaatgagagttcccttttagatttagaataaattttgacattcattttcttttaagcgtttaatgaaaaacatgttgtaccaaaaccatatacaaaacggtaccgactgcaatggataaaaacatgtttttttgccaaaaatgcagtactaatactacaataccagcaatgaaatcaggtataccacgatgacctgtcgtcagatcaatatttttatagcaatatactaccaacataccgaacattgctgccggtaatactttgcctaaatagcgaatatattccggtacagggcgattagctggaaaaatccagaaaggcaaccagcgaaaaagctgtacacctaaaattcccataccaatagtgattaactgttcatgaaaagtcacttatctctccctatctatccaatttagtcgccagtttttgcgataatattgaacggcgtaatgttaaatacaaccaaatgccaatcagtgttggaataagaaaaccctctttccctaccgttaataaagaaatcaatgcgattccgaagccaaataatgaactttcatgagatttttcttttaaccaattttcagcaaaaataactaaaaataaggctgtcattgcaaattcaacaccggcgagatcaaaaggcaaaatagaaccgaatagcgtacctaaagcagcaccaatgatccaatagcaatgtaaatataaactgacaaaaaagaaaaaccagcctctatctatattatgaggaatttttgccatatagtttaaagaaaaagcttcgtcaactaatgtggcaatcaaataccaccgttttttacccaaatctccgctgtatttctccagcattgagatggcataaaaaatctgccgcccactgaccattaatgtgattaataaaacgtaccaaggagaaaaagtactaactaatgctcctgcaataataaattctaccgaacctgcataaattaaggttgccattaaaataggataccaagttgcaaatccttgcactttcatatataccccataggctatgcctaaaaacatgaatccggcaagaataggaaaagaatgaggcaaggctacttttgccgcattccatacggtttttgattgattaagatctgacatacaataactattctaaaatagacaatccgggcaaggtagaaaaacgttgagatttaataatctcatagaaatcatcaataaaggcaacatcattatccgtttctcggaaagcaccatagagatcgctatataacccttcatcagtaatttttcttgccacaacatagcctctatccaaataaggttttactgcccaaaacggcaatgtcgccacaccacgtttacttgctacaagttgaataatagcaatagttaattcacttgtacgtcgagaaggattgattcctttaggatgtaaaactttacgtagaagatcgagcatatcatcaggcacagggtaagttatcaaggtttgctcaacaaaatcttctgcttgccaaacctctttccccgccaaaggatgatcctttgcacacaaaccaaccatttcataggaaaacaagggcttatgaataatacccggcgtttcttcaatttctgatactaccgcccaatcggctcgatgactcagcaataaaccaatagcatctgtatggaatccagacacaatatcaagttcaactaaaggccaatgttgacgaaaattatccatggcaggcatcagccaatcaaaacaagtatgacattctacagctatttttaactcgcccgcctctccttgtttaattctcgataaagctcgttcagtctccatgaccttaggcaaaatttcattggctaatttgatcaaccgctctcctgccgctgtaaaccgcaaaggatgacttttccgctcaaataaaggtaattgatattgttcttccaataatttaatttgatgcgaaagtgccgattgagttaaataaactctctttgccgccaaagaaacactcccagtttcttttaacgcaatgagcgtttttaaatgacgcaattcaagaaaaataggtttcatgaagattttgataacaaaaaataatttgccgtattgtacagcaaaataaaaggatcaaaaaggctttctcctctttgacccttagtcaactacatcaaggtaaaaccgatctttaccctctccacactaagtgcggtcagttattgacaaatttttcgcctaattcaatatcagctcgtaaagttggcaacatatcttctaaggctttttgttcaaatgcacttaaggtacccaccggtaaaatttcctctaccccttcttttcctaagcgaacaggttgtgcaaagaaacgagcatatttaccatcaccttcaacatacgtacattccacaacagtttcaccacttagcccctgtaccagtgagagagcaaaacgtgctgctgcttgagccattgaaagtgtagcagaaccgccacccgctttcgcttcaacaacctcagtaccggcattttgaatacgttttgttaatggtgctatttcgtcctctttccattcggtatattgcacttgggataacaatggaagaatcgtcacaccggaatgtccgccaattaccggtaccgcaatgcgtgaaacattgagtcctttcaattcagcaacaaaagtttcagaacgtaatacatctaatgttgttaccccaaataatttacgtttatcataaacgcctgcttttttcagcacttcagcagcaattgctactgttgtattaaccggattggtaataatacccacacaggctttaggacaagttttagcgactttttcaattaaatttttcacaatacctgcattaatattaaataaatctgaacgatccattcccggtttacgagcaacaccggcagaaattagtacaacatcagcgttttctaaagcgggagttggatcttcccctgcaaaaccttgtatcttcaccgctgtcggaatatggcttacatcagccgcaacacccggtgtaacaggtgcaatatcatataatgataattctgaacccgcaggtaattgtagttttaataacagagccaatgcttgaccaatgcccccggccgcacctaaaacagctattttcataagaacctccttatactcatacagttacaaattgaaccgcacgaattttaaaatgatcaagttcttatttcaaacaaagaaattaaattgtgcgatctacctcaaatttttaacaaaaattatttttaaatgttgaaaactaagaatataaatataaaaattatctacctattttgcatttttatgcagcattccccaacgtcgatttaagagagaatacataatgattaatgaaaaagcagatagcctagtcaacgcttttaaagagctactttcccaagaaagctttggttcccaaagcgaaattgttagtgctttacaacaaatgggatttactcatgttaaccaatcaaaagtctccagaatgttaacaaaatttggagcagtgagaacacgaaatactcgtatggaaatggtatattgtcttcctaatgaattgagtatacctaataccggtagcccattaaaaaatctcgtgttagatgtagatcataacgaaacattaattgttatcaaaaccagtcccggtgcggcacaactcatcgcaagattactggattcggttggcaaatctgaggggattttaggcacaattgcaggagatgatactattttcgttacccccaccacaggaaatgatattcaggttttaattactaatatccaaaaattattcgaaagttctttataggattgcgatgaggaacataagatgaaaatattcatcacaggtgccaccggattgattggctcaaacttaatccctctcttactggaaaaagagtatcaaattaccgctttagttagggatatggagaaagctcgtcatcagctacctaatcaagttcagttggtcaaagcactgtctcattatgagaatttcaatgattttgatggcgttatcaaccttgccggagccccgatttttgcccaatattggacagccggctataaaaccgaactcattaatagtcgccttaatttaacggaaaatttaaccgcacttattaataacagtaacaaacctccacattgtttcatttccgcttccgcaacaggttattatggcgatcaaggaaataatctcattactgaaaaatctctgagcggaaatcaatttaccgctcaattgtgtcaacaatgggaaaatattgctttacaagccaacagcagagtgtgtttattacgcactggaatggtgttttccgaaaaaggcggtgcattaacaaaaattctaccaatttatcgttatggacttggaggaaaactcggtaccggcaaacaattctgggcatggattagcttacaagatatgctacaagctattctgttcttgctggaaaatgcacaatacaaaggtgcgtttaatctcgttgcaccaaaacctattcaaaataaagatttcaattgccaattaggtgcatggcaaaaacgtccttatttcgcaacagttcctaaatttttacttaatttattgttaggtgaacgagcgaccattttattagacagtcaaaatgttattccacaaaaattattggaagccggatttcattttagcacgccgacattcagcgattttttacattcaataaagaaataggatatgttatttacaaaaaaaccaccgcacttaattagtgcggtggttttttcttagggtgtagcaagttggctaaattaccactgataccccacaccaaccgaaccgccgacatcgcccgttgaactgcgagtaccttgcaatcgtagcgttattttaccattatcacttactcgtgaataacctaacgccaccgcactttgtcctttataggaacctgccgaagcagcaaacatggatttacccggcacagaagacatcggcaaacctgaagttgccaaagcacccgcaatccccgctcgcaattctttattggacatatccagtttattgttgagattgctgagtttttggtcggtttgtctttgtaaagtatccacatatttcttattcaccaccgcactttcactggttgttggtttaatatccggtacggtaataatacctttttcaccatcaatcttaatttcaccgtttgctccggttacggttaagccgtttttattaagaacrgyttttggcatttttggattttgctgattttgtgtcgttacgttgtcagcaaagrtaaggctttcagcagttattgtkgctttattgccagttttcttatcttccaacatgatattgtccgcaccatargtkgcmgakttgtctttgttgctaccatttttgttgttgacaacagttaagccctcgctatttaacgtcgatttyttaccgcyctcctctttggtttcraaggctttcatatttttcaasgtatccgacagttttatttctaarccrtctttggctgtattggyttctaccttaatgttaccagcggcactactaaatgaacttgtagtttgaccgttttgagtttcctcttcccctttaatagttaaggtatcgctgatttttctgacyacatcatcgccctgatttcctttaaatctcaacccagcttgtgcaaccgcttttaartcagcgagattrgcsgcttkrtgcagrtcttgttgctcagtcattttttgcccttgctggctacttatgccgttggaaaccagttttttcactagatcaagggatttaccttgtttttcagattcagacttacctttcatactatcattatcaattcccaaggcggattttagatttttgatggcaacagggtcatgagccttacctccattttgaggtttaccgcctaaagtgattgattttttatgttcatcatcatatttcaccgtcactttatccgcttctgcctgtttatcggcgatggtttggattttgtttttcacaaattttttcaccgcaccggcagtcgtgagttttttgtcttcagcactagaatttccgtcagaaccgtccgcacttccattttccttaatttcttcagttgcctctattttgaaggaaattgttccggtgttggcatcaatactcggtttgatatagtcatcaccttttaacttaattgtcgcaccaagctgacgtgtcattttgttggttgatgtaccgccggtttgaggtgcggtcgtagttgctgttgttgtagtaccatcgtccacctcaaaaattaaacctttgttaatggttttaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgtgcttgtgccgtgttggaattatccgcttcaatttttagcgttaatgaatccaattgagtttttaagtaatttttaaccgcactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgtccaccgttaattgcgtcagtggaaccatctcggacttcgcctgcagcaacgtgggtgatgatacgttctgagcctgtagaaccaacgctgacgacttcttttttattgccttccatnnnnnnnnnnnnnnnnnnnnnnnnnnnnnnnnnnnnnnnnnnnnnnnnnnnnnnnnnnnnnnnnnnnnnnnnnntaggtgcggtctttttcgtctctagttttgaatttttacccaacgcaaaggaattatcgccgttgccattaacagtaatcacttccaactttttcttcactgactcgccaagtttaatggtaacggttggcttgtctttttgaacttctgttttgatgaaatcactttcacctgttatttttagtttgtgtttatttaactcaactttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgacgggtcatttcagttgaatttccagcagaaccgcccgcacttgtgccgttttcgactttgaatttcaagccctcattgattttagcgatgtttttatcaatcgcgtctttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcaccctccccaatcgctaccgcacctgcggcacttgcttgaacagtcgcatctttaccaataacmaccgcactttccgctttggaaattgcctgtttaccgataatgacggagtttttggcgtttgttattgtgctattacttccgccgttattaccatttcctattacaattaaatctgcattgttagttcctacattaagattacttcctattgcaactacattattaccggaaccagttatttttatttyrtttcctaatgcggttgaccattgagaattggctattttggttyctystgttactcctatcgctattgaagaatcgctagyttccactatttttgtttgataccccaacgctaacgattgaatggatttaacttgagtttctgcacctacagcagttgaccatttggcattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatgttaaatcagtcccaccgacttttaacgtggcagttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtcgccttagaatttctccccaacgcaatggaatcgccagcggcggtggatacaaacgcactctccccaatcgctaccgcacctgtggcgttggcttgaacattcgcacctttaccgagtaccaccgcactttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaatattattccccaacgccacgatatctgtgccgctgttgattttgtttttattcccaagggctaatgaccattcggcattatctaattttgtatggtcagaaccatttccttcattaaccgcactgatagcgattgagccttttgcattgttgaatgtaacgccgttaccaacagcgacaacagcatcttgtttttctttactgccttgtgtaaccgtaatacctgagcctaacaacacggaatgttttacatcaacattcaagtccttaccaattacaatcgcttgttcagcttttgatttcgcttcgtacccaagggcgatggcatatttttcggtcgcttccgcccccacaccgatagcgatagcaccctccatctttgctccatcgttattgtagttgccttttgtgccactcgaaccgctagaaccgctacctgcaccgtttgtaccatcattcaccgacaaataatgcaaagattgcgtaccagtactgcttccgccacttccgccaccgcttgtaattttactatttacatagtctctaactgcttttacagtcgttaattttttgtcattgccgttgctgttaccgcctgatgtgctgttaattgaatcagtcgcattgacggcaagcttaattgtgtccttaccactactaccttcagtgcttaaagtcagataatcgtcgcctttaaaggtcaatgattgtccgagttgtcttttgatagtattgttgttactgctaccacttccatttcccccaactttaaaggtcattccttggtttatggcttcaatagtatcttgaatagcttctctaaacgtggtttgactttttcttgtatatccattactttgaactggcttaaacgttgattttccgaaacgttttccaccatcactttctccatcaagccaaacttgtgcacctaacacctctgagcctaatttcccaaaggcttcaatcacgctatataattgtccgccatttaccgcatcggttgagccattttgcaccttacctgcagcgacatgttttagtagggtttcggtgctaccgcttcctacattaataacgtttttattttcaccagcacctgcgtctttccatctaattcgtatagaatccgaaccaacattcacctctgcactactaggggctaattcttgaccccctctcgaaaataaatcacttaactccgtggctttggtgattttttgggttatatcgtctttgagtttgattttgatggggttacttgaacaattgtgtattccttgattgtttgaagccccaaatccccctcctgctccattgccttgtttactacaagtaaatgatcctacatctacatcgataaaaccttctccctttatccccgttttcatcatgttttggacatctttcgcttcaccatcttgtaatcctgtaacaccgggggaaaaaccttgtcccaaaacctccaccggcaacaccaccgacaacgctaacgccagcggtgcgagtttaaacgccccgaaaacaccgaaaaacacaccgcacttcggcttactctccgaactgctcgctatttggcgattacttgccaactcggaaacggctttacattgacctgttgtaatatcatatttggttttgaagattttgttcatattctttactcactgtttgtttattcatctgttttttggggtttttgttgtgtttttatatttatagagcggttataaacctaagcggaaaattgctttgctttttaaggcatagcaaaaaaagacgaatgatattttcgccgaggggttgaaaagggaaaatggggatatttttaaaggttaataatataaaaaataggttgcagggcttgcaacaaggcgttagcctagactgtagactgtagactgtagactgtagactgtagactgtagactgtagactgtagactgtagactgtagactgtagactgtagactgtagactgtagactgtagactgtcatttttcctgttctattttatttgtcaagtaaaaattcttgctatcctatcctaaatttttatagaaagaaacgatttttttactttttatcctaacttgattgaggcgaacaattaaaatgtttgatattcaaagaggattaaatcatcaccgcactttttagcataacgaaaaatcctagctccctattgggtaagagttcacatttatatggctcgatcagataaaattgaacgcttaaaagtgcggtacatttttcagagatttcatttttctgttgttcttacgctgagaaatagcgataatgtgcgatctagaaaatccattgaagacttatgatagattatattttactgattattagtaccgcactgattaataactttgttctagttaaattcttaggactctgtccgtttatgggcgtttcaaaaaaaattgaaactgcgattggcatgggattagcgacaatgtttgtacttactgttgcctcgttgtgtgcttatttagttgagcgttatttactcactccactccatgcaaatttcttacgcactttgatttttattcttgttatcgctgttgtcgtacaatttactgaaatggtcattcataaaacgagcccaacactttatcgtttactgggtatttttctccctttgattaccactaattgtgcagttcttggcgttgcactgcttaatataaacttagctcataacttaactcaatccgtcatttatggattttctgcgtcgcttggtttttctcttgttctagttttatttgcgggattgcgtgaacgtcttgcagcagcagatattccccttccctttcggggagcctctattgcgttaattaccgctggactaatgtctcttgcctttatgggctttaccggtttagtgagagtgtaaataatggcaacattacattacgttctgctggttgttgttttgcttgccgttctttttggggtaatcttaggctttgcctccattaaattaaaagttgaaggcgatcctatcgtagaaaaaattgatgcgttgttaccacaaagtcaatgtgcacaatgcggttatcccggttgcaaaccttatgctcaagctattgcgaatggagatgaaatcactaagtgtgtacctggtgggcaaccattagtcatcaaaatagcagatttattaggcatagaagcacctagcggtaattttgaaaaagatcccctacccaaagtggcattcattgacgaagatatgtgtattggttgtacaaaatgtattcaagcctgccctgttgatgccatcattggtacaaataaagcgatgcacaccattattgccgatctttgtaccggttgtgaactttgtgttgcaccttgcccaacagattgtatttcaatgatcaacgtcaaacaacatattgataactgggattggaagttcgatcctaagttagttattcccatcgttgatactacttcagcacaaaagaaaatcgttgtaggagaatagggaatgacacagcgtatagatatattaaccaattacaattcaggtaaactttgggatttttatggaggtattcatccgccggagatgaaatctcaatccaatcaaaaccctataaaaaacttgcctttagccaatacattttatgttccggtcaagcaacatgccggaagtgcgggtaatattttggttaaggtaggagatagagtcttaaaaggtcaagcgttgacaaccggctcaggtttgaaaacattgcctgttcatgcccctacatcaggtattatcaaaaatattgccccttatgttgccgctcatccttcaggtctatgcgaattaagtattgaaattgaagccgatggattggaacaatggcgaaaacgccactcgatagaggactttttaacacttagccgagaacaactcattgataaaatttaccaagcaggtatcgcaggattaggcggtgcggtttttccgactgctgcaaaaatccagtcagcaaacaataaggttaaattactaattatcaatggtgcagaatgtgagccttatatcacttgtgatgatcgcctaatgcgtgactacagcgaagagattattgagggtatacgtattcttcgctatatcttacgccctgaaaaagcggtgattgcaattgaagataataaaccggaagctatcgcagcattgcgacaaagtttgcatggtgctaacgatattgatattcgtgtcattccaactaaatatccttccggtgcagcaaagcaacttatccaaattctaacaggatttgaggtagcaagcggacaacgctcttccagtatgggtattttaatgcacaatgtgggaacagcttttgccataaaacgtgccattattaatgatgaacctttaattgaacgagtagttaccttaaccggagataaaattgcacaaaaagggaatttttgggttcctttgggaacgccaatctcccatgtactaacacaagtcgcctatcaatatgattcacgtttccctgtttttatgggtgggcctatgatgggattcatcttaccgaatttatatgcccctgtaactaaagcgactaactgcttgctggcaccggatcattttgaatatgaaccgccggcaacggaacaatcttgtattcgttgctctgcttgctccgatgcctgccctgtacatttaatgcctcaacaactgtattggtttgccagagcggaggatcataaaaagtccgaagaatacgccctaaaagagtgtattgaatgtggtttatgtgcctatgtttgtccgagtcatattcctctcattcaatatttccgccaagaaaaagcaaaaatttgggaaattaaagaaaaggcacaaaaatcagaagaagccaaaattcgttttgaggctcgtcaagctcgcttagaaaaagaagaacaagaacgcagagcaagggttaataaagcggcagaaaaccgccgtgcagaaatggcacaacaaaaaggaattgatccagttcaagccgcacttgaacgcttaaaagcgaagaaatcaatcgaaacacgtgaacacaaccaagaacagaaaacgtttataaatattaaaggcgaaatattgcctgataacagcgacatcatagagcaacgtaaagcacgtcgtttggctcgtcagcaaaccaattcaaacagcattcaagaaattgaaactgttgtacaaaattcggagaaaaatacagaaaaaagtgcggtacaatctggcgtagatccgaaaaaagccgctgttgctgctgctattgctcgtgctaaagcaaaaaaacaggcttcacaaattactgcaaatagtatttcggagcctgatactacaatacaaaatacagaaaaaagtgcggtgcaatctggcgtagatccgaaaaaagccgctgttgccgctgctattgctcgtgctaaagcaaaaaaacaggcttcacaaattactgcaaatagtatttcggagcctgatactacaatacaaaatacagaaaaaagtgcggtacaatctgacatagatccgaaaaaagccgctgttgccgctgctattgctcgtgctaaagcaaagcaattagcaaaaaaacaaattgaagttaccaataaatgaaacaaagagattttacatgtttaaaatgattagctccccacatactcattcggggaaattgacagcccgcataatgttatgggtgattgtggcaatgttaccggcaatcgcagggcaagtatattacttcggatttggcgttttgatccaatcactgttggcaataagtacggcgttatccctcgagtttgttgtaaccttattgcgtaaaaaaccaaaatttttttatattggtgattttagcgttgttttgaccgcacttattctcgcagttgccattccgccttatgccccctattgggttattattatcggtacatgttgtgctgtaattttaggtaaacacgtttacggcggattaggacaaaatttatttaatccagcaatggttggctatgtcattttgcttatttcatttcccctacaaatgacaacttggttacctccaattcaactgcttaacgagccacctcattttgccgatgcgtataaactcattttccaaggtgttaccactgatggttttaatttaagccaattaatattggctattgacggtatgagccaagcaacgccattagacacagttaaaacagcgttgcggaacaatttatcttcattacacgaagtcagctcatcacctattttcagttcggttctaccattgggcaaaagggatattgttgaaggaatgggctggacacaaataaatttactcttttttctagggggtatcttcctaatttggaaaaaaattattcattggcaaattccaaccgcacttttagcaacaatttttagttttgcattgttgaactggttattttccccagtcacaccaaatcccatttggcatttagtcagcggtgctacaatgttcggtgcattctttattgccacagatcctgttaccgcctccattacaccgagaggaaaactcattttcggtgctttagtcggattattaatctgcttaattcgtttttggggaaattatcctgatggcgttgcttttgctattttactggcgaatatttgcgtgccactaattgatcattacactcgtccacgtgttataggtcataacaaaaaaggaatcaaacaatgagcgttgcacaaataagtagaaaatatggcatattgttgggaacagtcgcctttatttgtaccgcactttccggtgcggtatattggctcacgaaggataaaattgcttttgcaatcgctaagcaagagaaaatgctgttagctgaagtaatgcctccaaattattatgacaatgatctgttagccgattgcaaaatgctctcatcttctttggcaaaagaatatcgtattaataaactttgtacagcaaaaaaaaatcagcaaattagtgcttacgcttatgaaactatcgcaccggacggctactccggcaatataaaaatgttggtcgcaattactcgacaaggcgaagtgctgggcgttcgaattacggaacatcaagaaacccccggtctaggcgataaaattgaattacgaatttccgattgggtcctgaattttgcccataaaatgttacagccaaacaatttaaacgattgggcagtcaaaaaagacggcggtcaattcgatcaatttaccggtgctaccattacacctcgtgctgttgtaaatcaagttaaaacttctgggataatacttctaacacaacttgataaacttgctgtggagaatgaagaatgagtacaaaaaatctacccgaaacacaccgcactttagatgaatttgaaccctctcatttgactgtaaacaaggttaaaaccgaaagtgtatgggtaaatttatttaaacaaggattttggcataacaaccctgccctagttcagctattaggactctgccctttacttgcggtatcaaattcagcgacaaatgctttaggtttaggcattgcaactattatcgttttaatttgtagcaatactgtagtttctttgtttcgcaaacaaatccctcaagagatccgtatccccatttatgtgatgattattgcgactacggtaacgatagtgcaacttatcatgaatgcttatacttacaccctttatcaagcattaggtatttttattccattgattgtgaccaactgcattgtgattgggcgtgcggaagcgtttgcctcaaaaaataccgttttacattccatttttgatgggtttgctatgggacttggcatgaccttcagtttatttattttaggtgcattacgtgaaattttcggtacggggaaattattttttggtatagaaaatttatttggcgactgggcaaaatgtttacaactgaacctatttcaattagacaatagtttcttactggcaatcttaccgcccggagcgtttatcggtctaggcattatgttagcaataaaaaacgtgatagatcacagaaaatgaataaacaaaaacgtatcgaaatattaactcgtctgcgtgatcaaaatccgcaccccacaactgaattgcattttaatacgccttttgaattacttattgcagtcattctctctgcacaagcaacagataaaggagtaaataaagcaacggataaactttttcctttagctaataccccacaagccattttagatcttggtttggatgagttaaaaaaatatataaaaacgattgggttatacaatagtaaagctgaaaatattattaaaacttgccgtgatttaattgaaaagcacaatggtcaagttccggaaaatcgagaagcattggaagcactggcaggcgtaggcagaaaaacggctaatgttgttcttaatacagcttttggtcatcctactattgccgttgacacacatattttccgagtgtctaatcgtacgggatttgctcccggaaaagatgtcgtaaaagtagaagaaaaattattgaaagttgtaccatcagagtttaaagtggatgtacaccactggttaattttacatggtcgctatacttgcattgcaagaaaaccgagatgtggctcttgtattattgaagacttatgtgaatttaaagaaaaaacagagatttaacataaattataaatagaaacgaaggtataacattatgacaaacaccccaaaaagacaaacttggtccagtcgattaacctatgtcatgacagtagccggagcaaccgttggatttggtgcaacttggcgatttccttatttagtaggtgaaaatggcggcggtgcttatgtactgctcttttgtattgccatgttagttatcggcattccaatgattttagtggaaaatgtcatcggtcgtcgcttacgtgttaattcaattgatgcattcagtgataaattagaaggaaaaaatatttctaaagcgtggaaaattattggctatatgggattactcggtgcatttggtattatggcgtactatatggtacttggtggttgggtaatgaattatatcatcaatctcattaccggttccctagatatttcatcggtaattaacaaagaatatgcccaaaatttttatcaagagagtattactgaaagtccgctacaaatcataatttatacactgatttttgtcgtcattaactatattattcttgctaaaggaattattggcggcattgagcaagcggtaaaatatttgatgcccttattgtttatttgccttatcggtatggttattcgtaacgttactttaccgggagcaatggaaggaattatttattacctcaaacctgatttttctaaaatcacgccacaattgtttatcctcgtacttggacaagttttctttgcactaagtttgggatttggtgtaattatcacactttccagttacctcagcaaagaagaaaatctcatccaaaccgccgttataaccggatttacaaatacaattatagctgtcctgtcaggctttatgattttcccgtcattatttacttttgggattgaaccgaatgcaggaccaaccttagttttccaaagtttacccattgttttctcacacttatgggcagggcgtatttttgctgttgtcttctttagcttactgctcatcgcagccctaacaacctcaatcaccatttatgaagtaattattaccgcactacaagaaaaacttagaatgcgtcgtgcaaaagcaatttttatcacgttaggcacaattttcttaatcggtaatattccatcaatattaagtgataatttgttaaaagacgtcacattctttggtaaaagtatcttcgatacgtttgattacgtcagcggtaatattttatttttattgaccgcacttgggtgtgctatttttgtaggctttgtactaaaagaagatgcgataaaagaactctccccaaatccaaattctttatcgactcagatttggttcaattatgtaaaatttgctgtaccattaattattatcgtgatttttgtaagtaattttgtttaatctaaaactgtttaatttatagaggacactatacaccatatatttatctcagataaaaataatgatatccgtcgtcatcatattgaaaatgaaactaaaaaattagggattacccctaatttttatgatgcaattatggcacgtgatttatcaaaagaagaattatcaacgcttactatccctaatacatttttaaccccaggagaaatttgttgtgcaaaaagtcatctggaggggggggggtaaaacgattgttagaaagcaatcaagaatacatttttatttttgaagatgatattctcttttctgataactttacgcctgaagtcattaacgaaattacaaactttatatcctctttgcaaaatccatctattctagttttatttaacagcatttataaaaagaaaaaagtaaaagatcttaatagtgctatatctattttttctgctcacaatttattctatgcttgtggctatgtcattaacagacaagcagcagaaaatattctaaacatccaaacgccaatcaagtttgaaattgatgcttttaagttttattactggttagatgcctgcgatttatattgtctaaatactgacttagtaaaacccgctccagaaatttcaaacttatcagagatagattgcgacaaccctagaaaatatacaaagcaacgcacaattaagaaaaataacgcatatcgtcttttatacaatcaactgagttggcaaaataaattaaaagcaaatataaagagaatacaaaaaatgttacataaaccctttgaaaaattgtagtttgtaatacattctgaatgggtagctttgtaggcagaaatcaataatctaactttttaggttagattatttctgttatttactcctttaagatacctaaattccaattttctgctgacgttggacgtttttcttgcaataagaaacgttgatttgcctttgcttgaggttgtattactttacttgatggtgtagagaaagaaataccgcctttaagcaattgctgcatggttcccgtattaatggacaatccgctcaagccaatttccacaccgtacccggaagaaatccaaaactctgtattttggcgaacaaagtgttggtatttcttagcaattaataaatgaactaaaactcgatcacctaattgatttagttccagtttagatatagtacctacctctataccacgatacatcacaggagatccgatactgatgtttgtggcatcagtggcttccagaataattggaaagccgttgccgtatttgtttgccggaggtacggacgaaagcaaattaaagtttgttttttttgcaccttgtccaatttctacatcaatataaggttgtaataaactatcaatattatcaatgccaccggctgaaatgtgcggtgaaataaggcgaaatttactgttttctttcgcaatgatattcatgtattttgcatgaattaatgcagtagcctcgattttatgatcttcggttagattaatttgctctatttctcctataggaagccccatatagcgtagtgccatacctttagtcaagtttgttgcatcatcagcaataaacgtaataacttgttctgccgatttggctttcatttcatttgcataaagggttttattgcttcctgagcctgaattatcaaaactgaccgcacctttcaaagaacgggcgataggggttgcctgaatactaatgccctttggcgttatatcaatttgtgtcgcactttctacccaaaaaagacttttggttgtaagtaaatgtttatgtttggggtaaataaaaacatcaacttcaaaatgattagccgttggtctaatatctaaaatcttaccaacttcatattgacgataaagtacaagcgagcctttatttatacttggtagattttttgtagttaacgtgatattaggctctaaaatattatcggtaataccgaattctgcactggttaaatccttatacaaaggatattcttgttgtgcttgtccttcctttttaccgcttgatataaccctaattcccccttgcaaccattttttcggactagcagcttccattcttaagccatcaatacccaaactaatatcaaagttactcgctgcaataaataatgtatttttatgaataagttgacgatatttttctgctattgctacttggaaaataacgcgttccagtgtactggtaatgttgacaatttcgccaatattttggtgattatagtaaagtggttgcccttctgtaataccgtaggtttcgggtgaaatgaggtttattactagggtattgggttgtttgagtaaaagctcgttttctttaatgacatgaaaagtcgtttgtgcttctcccataccggcaataacatcaatgtattttcctcgcaaaaaatttttcacatcggttaaatcgccgagcgaaagtttttgatcacgtaaaacaagaattgagcctgttttaaacaaatatttcatattcggatcaactaataatttcccgtgtaaaattttttcgctattttctaccgcacttaattcagataacacgccaatttgtatatcttgcgaatagattttagtgtgtccagcatctaatcctgctacattaggaacaataacgttgatttccgtacctcttttagcagcttgaatattttcatataacgtatagtgtgcattattttcagctctaggactttctcttggagaatcaaatgcaacagccccctgtactattgcgtttaagctatctgcttgaatattgatacctgataaacttaaatttgcgttgattccggtaatgttccaaaaatgactgtcttttttgacaaagtgagaataggctttgttgatgataacatcaacttcaacttttttctgatctttcgtgaaccggtaatcggcaatttgtcccacaggaatttttttaaagtaaaccgaggctccgctggataaagaacccaaatcatctgccagtaaatgaattaacaaatcaccatcattaacttgtgttaatggagcttcggtttccgcaataaacgtattttccggcttaccaccgccgggttgtaatgtgatataattaccagaaactaaagcatcaattccggagattcccgccaaagaagcactaggctgcactaaccaaaattttgtattttccttgaggatgctttttgcctccggataaatatttgctaatacttccacttttttgagatcatcagtgaaatttactttttttactacgccaatttgtaacccttgatagcgaatttgtgtttttccggcaactaaaccggctccattcacaaaagttatcttaatactttccccttgctctttaataatctgaaagaacaaaagtgtacagatacataatgcaataaagggcagtaaccaaaaaggcgatatacgtttggtttgtttaatttgggctttcaattcttccattgtttctatttgattatctaattttttgtttgtcataaatattccaaagtaaacgactatcaaattgtgaagtcgacatcattgttaaaaataccgttgctccgaaataaaatgcggcaggacctactgaaaaatcaataagttgccctcttgttactaatgacatcatcagagcaagtacaaataagtcaagcatggaccaacgtcctacgaaatgtacaaaatggagcaagcgtatttgcaggtgaatcgaatgttgccatttaaaatgaatggagaacaaaagataacacataattaaaatcttactgaaaggaataaaaatactggcaacaaatacaacaaatgctacaaagtagcttcctaaattgataaaggtcagaacgccggacattaatgtgtcttctgttgctataccgttcacataaactatcgacattggaagcaaattagcaggaataatcattacgaccgcagccaataaggttgcccaagttcgctgtaaatagacttcatctgaaaaatcaaggcgtgatagacaacgtgggcaaatggggcgtcgttttctatccgtatgacaatgattgaaagtatgttcacaatgcttgcacgcaataataggaagatttttttgttgtagcggagttttttggggataaaaatgccgccacaattcagcaggattgatttttataaataataatgtggtcaaaagtgcggtaaaaataaatgcaattaaatagctattaatatgtaggcttgcatattcttgtactttgaacatggttacgcccaaagcaactaaataaacatcaaacatcacccagggttttagataatttaacgttaacagtaagtgacgaggtctgatgtctaatagctgtgataaacgaagtaaaataactaataaagcaaagcttataggcataaataccgcacatagaaaaatcataaatgcagtgtaaggatagccttgaattgccattttccatataccttgccaaacagacgcatttactggcgtaccaagcaggttgatggttaataatgggtatcctaaggcaaacggcattaaaatcaaaatagtcaatgcgatgattgcacaacgtttcaaattccaactggaggtgttttgcagtactttgtgacaacgaggacaattcgctgattgatttttttgtaataagccaacagaaactaacgcattacaatcagtgcaacttataaggcagtatttagcttgtgataaattagtttttttctgcatgttgtcttattgatgaataataaagaaaggctattctaacctaatttttatcggaaatactatttttcattatagccataagagaaaagtgcggtcatttttagtgaaagtttcgtttcatttaagtattaattgtttatttttttttgttttaagctaaaatgtggcgagtttttttatctaaaaagtcattaagacaggaatatataacatgactgaaattcaaaaattaacaaataacaaagaaattattgcttacttagcagaaaagttcccattatgtttttcattggaaggtgaagcgaaaccattgaaaattggtttatttcaggatttggctgaagcgttagcaaacgatgaaaaagtgagtaaaactcaattacgccaagccttgcgtcaatatacttctaactggcgttatttacatggttgtcgtgccggtgcggtacgtgtggatttaaatggtgaacctgccggtattttagaacaagagcacgttgagcatgccgcagctaagttagcagaagctaaagcgaaagttgctgaaagacgtgcggttgaaaaagcaaataatccaaaagcaaataaaaaacgctctgtacatcgttcagcgaataagtcagaaaataagaaatcagctggaaagaaattctccaaaccccgtcaagttgaacaaatttttgtcaacgttgatttagcaaatttacaaaaaggagatgtggtgagagttaaagcgggagataaaactactaaggctgagatattagaagtggttaaagagggtgcccgtgttgaattagagaatggattgatattaactgtaagtgcggatcgtttatttgcgtaattttataatacatggctaatttagtacctcgtctcctctggtattattttcgtgtttaattattttaggaaagtgatctatgaaattacctcaacaactgcgttatttgctttgtttgctgtttggctttgttttaagtttaaattatgccgtcgcagttgaaccaaaactgaaactaacggatcttgttattccacagataacgcaagaaaatcaattagcaactaaaagaactgctgctcgtttggttcattcacattatcaagcagtagaactcaatgatgagttttctcagcggatttttgatcgttatttgaaagcacttgattttaatcgtaatacttttttgcaatctgatattgataatatgagagcaacgtatgcggataaaattgatgatgtgttaaatgagggaaaactagatattgcctttaatatgtatgagttattgatgaagcgtcgctatgagcgttatcgttatgctctatctttattggatgaagagcctgatttaaatggcaatgatcaaattgaaatagatcgggaaaaagcggattggccaaaaaatgaaactgaggcaaataagttatgggaacatcgagtcaaaaatgatgtgattaacttaaagttaaaaggtaaaaaatggcctgaaattcaaacgaggttagttaaacgttataatttagctattcagcatctaagtaaagtaaagtctgatgatattgtacaattgtatttgaatgcttttgcaagagagattgatccccataccagttatctggcacctcgcacagctaaaaatttcaatgaaaacatgaacttgtctcttgagggaataggtgcaactttacagtcagaagatggtgaaaccactataaaatcgcttgttcccggtgctccagcagatcgtagtaaaaagcttaaagccggtgataaaattattggagtcgggcaagcgacaggggaaattgaagatgtagtcggttggcgtattgatgatgttgttgataaaatcaaggggaagaaaggaacaaaagttcgtttagaaatagaaccagctaaaggtggaaaatctcaaattattacgttagtgcgagatcgtgttcgtttagaagatcaggctgctaaactaacagttgaaactgttgctggtaacaagatcgccgtgattaaaattccggggttttataatggcttaactgaggatgtacgtaaattacttgttgaagttgaagctaaaaaagcggaagctttaatcattgatttacgtggaaatggtggtggctctttaccggaagctattgagttaaccggtttatttattactgacggtcctgtggttcaagttcgggacgcacatcaacgtattcgtatatatgatgatcctgatacagagcaagtttattccggtcccttgcttgttatgattgaccgatttagtgcatccgcatcggagattttttcagctgcgatgcaagattataatcgagctattattcttgggcaaaatacttttggcaaaggaacggttcagcaaagtagatcactgaactttgtatatgattcaaatagtatggctcctttgggtttactgcaatatactattcaaaagttttatagaattaacggtggcagtactcaattaaaaggagtcgctccggatattatttttccctcctctattgatgatgaagaatatggggaagaaaaagaagataatgcgttaccttgggataaaattccatcagcgtcatattctgaagtcggtaatgcacgcctgccggtagatatattgaatcagaaacatcttgaacgtattgcgaaagaccctgagtttattgcactggatgaagatttaaagattcgtgatgaaagaaaagaacgtaagtttttatcgttgaactttactcaaagaaaagctgaaaatgataaagatgatgaaaaacgcttgaaagatcttaatgctcgtttcaaacgagaagggaaaaaaccactaaaagatcttgatgctttgccgaaagattatgaggatcctgatttttatttaaaagaagctctgaagattgcggtagatttaattgaatttaataaaaaaatggctgagtaaaataagatttaaaatatccgcacttttgaaaagtgcggtcttttttgttatctaaggaactaacatgcgaaaaattaaagttatcttattaatcttattattaggcactacgactcatatttatgcacaacaaaagtttacttctgtagatgagattaataacattactttaagtaaatcacaattattgtttgaattagatttattggaacaacaactatccaaggaatatcagcctagattatatgaacaattacattctttgctcagaaatatagatttacaatttaaaactacaattggtcgtatttatgttgaaaatgactatgcattgctttgggaagataagcaagccgaaaaaatgtttttacgtgaatatgccgcaatagttgcaagcggagtatctgaaagagcggcaagattattgaatgatatttataaagcatctgaaataggagggttagtttatgatatgttgctgaccgatgcatttttggattatatgtattattcaaaaaatgcaaaaaattttgcacaacagtggttttactcagcaaatagctacaaagctcaattaccatcaaaacaagatattcaacgatggctatcatcaataaaacataatgaaaatttgatgttcatcgaacaattagctcaacataatgagcaatatgagaaaattataactcacctgagtaaattaatacctcaagatgacaagtcaatattatacaaattagcaattaatgctcagcgtttaaggattattcctgattttaacaatggtatttttgttaatattccaagttatcaattaaattattatagagatggagaattagttttaaactctaaagtcattgtcggtaaaaaagcacgtaaaacaccggtaatgtatagtaagctaagtaatattgttgttaatccaccttggatacctactcctcgtttaattaatgaagatatcgtgccaaagattaaacttgatccggattatgttgctcgtaatagttataccataagtgatagcaaggggcaggttatagatccttcttcaatagattggaatactataggcactaattttccctatcgaatccgccaagctccgggaggaagtgcattaggaaactataaatttaatatgcccagttcagatgcaatttatttacacgatacacccaatagaggattatttagcaaaaaaaatagagcattaagttcaggttgtgttcgtgtagaaaagtcagatcaactggcgacaattttattaacagaagccggttggacagaagaacgtaagcaaaacgtgcttaatagtaaaaaaaatacttcggagaatattcgctccgataatcctgtatatttatattatgttactacttgggttgaaaacgatgtcgtgaaaacattacctgatatttatgagtatgatcaagtacctcatttaacttatattaactggaatattattaaatggtatctaaattaaaatgtgagcagcaagaactaaatgttatgtttgctgtcgaaagcaaatcatttagcactttataacgaaatattatatgaatgaaattaatcaaaatcgtcgcaaatggctatctttaggggggattattcttggtgcagccttgttacctcaaagtgttttagccgtattaccgaagccttctaaatctaaatttttatcttttagaaacatcaataccggagagagatttcgtggtgagttttttgccaataaaggtttttccagctctgatttgaaaaaaatagatcatttaatgcgagataaacgcaataatcaaattcataaaatggatcccaagttatttcataaatttgttcatattcaaaacaacttaggtttgcaaaattctgaaattcaaattatttgcgggtatcgttctccggcgagtaattccgccatgctacgtagtggtcgaggtgtcgcacgtaacagctatcatactcgtggacaagcaattgattttcgcattgagggggtttcattagcgaaacttcgtcaaacagcagaaaatttgaaaaatggcggtgttggttactatcctcgcagcaattttattcatgtggatacggggccagttcgtacttggcgaggtagctaaaatactaaacgtaatatagttgaccgcactttattcaaagtgcggttttattatttaaataaataaggaaatgatatgaatattgaaattgtgccggtaacggcatttcagcaaaattgttcaatcatttgggataataacaaaagtgcggctattattgatcccggtggtgaagcgacaaaattaattaaacgcattgaagaattaggcttaaatcttgaattgatcttactgacccatggacatattgatcatgtcggagccgcactgaagttaaaacaatattttaatgtagaaatttggggttctaatgaaaaagatgattttttatttaatagcttaccacaacaatctgagcaatttggcttactttttgagactgaggtatttaaacctgatagatggttaaatcaggagtatgaaattgtccgtattggggaaatgaattttgaagtattgcatcttccggggcatactcccggtcatgtcggttttatcgaatatagtaaaaaaattgcttttaccggagatgttttgttccaaaatagtatcggaagaacagactttccaagaggaaatcatgctgaattaattcaatctattcgtgacaagttatggaagttagatgatgatatgattattattgcaggacatggtaattatacaaccataggaaaagagaaaaaatacaatccttatatccgctaaaagttaagatgcaaattatgttattgatttacacttaaaggacaattcactagaatagtcaacatttattaatttatcttgaattctataaaggtagcaaaatgattgatccaactttattacgcaataatctttctgaaattgcggaaaaattaaaagtaagacgtggctttattctcgacgtaaataaattttcacaattagaagaacaacgtaagactttacaaattaaaacggaaactttacaagccgaacgtaactctcgctcaaaaacaattggtgcggcaaaagccagaggagaagatatttctactttattggcagaagttgatcatatgggagccgaattaaatactgtcaaagaagaattagcgaatgtattaacggaaattgagcaattggcattaacaattcccaatattcctgctgatgaagtacctttaggaaaagatgattctgataataaagaagtttttcgttggggaacaccaaaaaaatttgatttcgaagtgaaagatcatgttgccttaggggaaatattaggtgggctagattttgctgccggtgttaaattaagtggtgctcgttttgccgtaataaaagggcaaattgcaagaatgcatcgagccttggcacagtttatgctagatttacatactgagcaacatggctatacagaggcttatgtaccttatttagtcaatcatacaacactttatggaacggggcagttaccaaaatttggtgaggagttatttcatataaaacccctagaaaatgaacagacttatgcgttaatccctaccgccgaagtgcctgtaacaaacttagttcgagatgaaatcatcgatgaggctgatttaccaataaaaatgaccgcacatacgccttgtttccgttctgaagcaggttcttacggtcgtgatactcgaggtttaatccgtatgcatcaatttgataaggttgaattagtacaaattgttgaaccggaaaaatcaatggaagcactggaagaattgacaaatcaggcagaaaaagtattacaacttttaaatttaccttatcgtaaagttttattgtgtacaggcgacatgggattcggagctactaaaacatatgatttggaagtatggattccggcacaaaatacgtatcgtgagatttcttcttgctcaaatatgtgggatttccaagcacgtcgtatgcaagcccgttgtcgtgcaaaaggcgataaaaaaacacgcttagtacatactttaaatggatcgggactagctgttggtcgcactttagttgccattcttgaaaattatcaaaatgcagatggctctattaccgtaccggaagtattacgcccttatatgaatggaatagaaattattggtaaataatctgttgccgaaagataacaacgctccttttgggagcgttatctcatcaagccaaacctgtcataatcttactctcaaagaaatcataatctactaaaaaagcatcatgtccataatctgaaggaaattcataataatttaaatcaacgccactttgctccaataatgctttacttttatgtagatcggtcaatttaaacagctgatcagtggtaactgcgaccaaagtatagcgtgcttttatacgacttaatgcagccttaatgtccttatagttccaagacggatcatataaatctaaagcccgcaataaatgcacatagctattggcatcaaaacgttccaaaaattttttcccttgataagttaaataagattcaacttggaaataatctccccaatacagactttccgcttttttagctcgtccaaacgctttttctaattgaaaatcggtacgataggtcagcatacccaacattctcgcaatagataaccctttacttggaggcagtctgtcataataatctccattattaaaatgaggatcattaataatcgcttgacgcatcacatgattaaacccgattgcctccgcacttaaataaagtgacgaacaaagattaaccactctgctaacgcaatcaggataatcaatagcccattgtgtcgcttgcattcccccgaacgatccaccaatcacagcataaagttttgctatatccaatgtattcagcagttctcgctgaactttcaccatatcttgtacaataatatgcggaaactgactaccgtaaggtttatttgtatcaggattaatggacgaaggacctgttgtccctttacagccgcccaatacattagaacaaataaaaaaatatttactcgtatcaagtgccaatccctcccccataaaactctgccaccaaccattttgcgatttatcagcaaaatagggttcagcatcgccggtcaaagcatgacaaattaaaatgacattgctcttatctttatttaaagtaccataagtctgataagcaacttcaatattttttaattgcccaccttgtactaacatcaagggataatcggtaaaaagcgttaaagtttgtacagccatgtaaatttctcaaaaatcttaataaaaagcaccgcactttataaaagtaacccatgtaaactactcatactctgtttcattgtcaaggaatttttagccatctaaacatctggacagccaataaaatttacttgaaattacccgcttttttcattattttgtagcctccgaacgaggcagctataaaatgaacttaaatttcacacaactttcttttccacaatggataataacactcgtcaagcgattactacattacagctttgctttcagcatttttacatttttttcccttattatcattgatcgcagcatagcttggtatgttcaggacagaatttatacaaaaattgaagaacttccctcccgcccttatggtattgtattaggcacagcgaaatactttagtaaaaataatcccaatctctactacaacaatcgcctgactgctactgttgagctttttaaacaagagaaaattgattatttattattgagtggtgataacagaacaatgcaatacaatgaacccataacaatgtttaaagacctaagaaaaatgaatattccggaagatgttatgtatatggattttgccggttttagaacgttagattccgtcattcgtgcagataaagtctttaaagcacagcccatgacaattattacccaacaatttcactgcgaacgagctttatttatcgcaaaattctatgatatcgatgctatctgctttgcggcaaaatcacctgccaactacttatctgtacgaatgagagaattatttgcaagagtaaaagcgattttagatattgtattagaaaaagagccttattttttgggaaatccagaaccgctcccgacgccaataactcaattatgatcttcgctaaataatctagcaagcttataaaaaagacaataaagttaaaaatcccatcagacaacatattattttccaaccattttctaccgcacttttggcaaaacatttattaatcacgaacaagtaaaaattttaaggttttacacagacttatatttgtcaagattgaaaaaagaaaaaaaacagaaaaattttaaaaaaaacttctagacttaatgtaaccatttgaaaaataatgaaatgttattttacaaccaattttatatgaggatatggaaaccctagattttacaaggtttaagcgaaataaatcttgaataatttacagagttatccacaggttatgtggatagtaatttgcatgaaaaaatttttactataataaaaaaatcctgttgacaagcatacaccagatcattatcatacgcacctctccttatgagaccatatttatggtatttttcctccttagttcagtcggtagaacggcggactgttaatccgtatgtcgctggttcaagtccagcaggaggagccagttttttcttttgggttgtttttatttgtctccttttataaaaactcaatttaccaaaagactttaagcccatttagatcttctccttgtatgggcttttattttttcttttctatattcaaatttctcgaaatttattttatactccctgctttcacacttcatttatatctcgtttaggttcaaatatgttattccctatactcgctattatttcaggtttaattattttagtttggagtgctgatcgttttattgacggtgctgcatcgctggctcgtttcctcggtatgtccgcattattgatcggcattatcattgttggttttggaacatctgcccctgaaatgatcgtttctgccctttccgctttaaatggaaatcccgggcttgctttaggtaatgcttatggttcaaatattggtaatattgccctaattttaggtttaaccgccttaatcaaacctgttatagttaattcgctggttttaaaacaagaattacccattttaactttcgtcactttagtttctgcttacttaatttatgatgctgaaatttctcatttagatgcaattattttacttgttatttttgctatatacatggcttggagtatttggcaaagcaaaagatcagtacaagacagttttgccgaagatgtaacgacagaattggaagaaaaaaaaaccatatcagtaaaattagcagtattctggatgattacgggattgattttactaatgggaagctcacaattattggtgtggggagctgttcaaattgcttctcaattaggtgtaagtgatttagtgatcggtcttactattgtagcaattggcacttcattacctgagttagcagcctcaatcatggcggctcgtaaaggtgaagtagatcttgcggttggtaatattattggttctaatttatttaataccttagctgtcgttggcatagctggcttaatttccccaattcaagtgagcaatgaaatatttactcgagatatgttagttatgggaggattaacgctctcactgttccttttcggctatggatctcgtcaaaaaaatggctcgattaatcgtgttgaaggcggtttattgataacaagttatatcgtctatacttatttcctcattaccaccgcactttaaacaataaattaattgggagattaatttctcccaattaacaaagcacccccacgtatcggtaaagttgtgccatacattaaactcaaggcaaaaaatataatcatcagaccagcaagtatcctgactaggatatgccaaaacttcttatgtgttgaaaaataaaaatgccctaactgaaccgcacttttccgtgcatacaacacaattaatgcaaaacctgacagcattaatccaacacctaatgacatcgctacagtagccaacattccccaaacatacaaatccaacatatacgacaaaaataggataaatattgctccagaacaaggacgcattccaatagtgaaaataaccaaacattgtgattttaaactctgtgcttgctgtaactgttgctgattaggtaaatgctgatgcccacaagaacaattatccgtatgctcatgaaatcttggcaaattttgtaccgcactttgcatacctattttattggtaggtattgaagagagcgtgaattgcttgatttttagcgactgactattttttttcaaaaaagacttgctcccttgccaaatccattgcaatcccaaaataatcatcaagagataagctccacgttctaaccaaagctgacttaatttaaaatagctcgaggataactgtaaaatagccacaacaattaatgtcagggaaatcgccacaataccttgcattaaagaagcaaaaaaagttaatttcatactggtttttagctgggattgatgggttgctaaataactaccaataataaactttccatgccccggacctaacgcatggagaacaccataaataaaactcaccacaattaatcccattcctgcatagacaggggcttgttttacttgatgcaggtaacttgaaagtaattgattaaattctctctgccaaattaaaacgtgtgaaaataaatatgggaacagataaataccacctaacgataaaaatacaagtaataatataagtttataggttctttttattgacattggataactactttttgtgcaaatataacgcctaacgagctgtcttcatcacgttggttacgatctaaagaggcagcatactctcgtaatttttgatcaacttgaggttcgacaacatttccttgacaatgttgcggaagtgacgaaaaatctaccgcacttttctccttgtctttatcgtaatacatagatacatagtaggttgaatcataagtagataattcaaaacggttattggataactcctgaggtttagctaataaaaaatcaaaaaaatataaaacttgtgcaccgttagattttaatccatagttttgaggaattgcagaatacttaattttatttcctttcttatcatacaaataactaaaataatgttcattaacaacattttggatcatatcatcaataaatttttgtaattccttttgatcatcttgcaaaaaagccaaatcatataaaacagcagatgaacttgattcatctaaaatccattgcatagaaaaaccaactaatttttgcttgtcaataatgggttttgtctgcatttcaataaaagcgtgtgggtgagctaaactgtatataggcaaaaaaccaagaataatcccgaataaacgaatgaattgttgcatattcttccaatcaaataactaagtacgcattatgctatcacaatatagcgttgatttttatcttttcaaaaaaatcatgagaagttgagtttgcggaaattaagccccctaaagaacagagttttacggcaccgtcagataaaaaacttacggattatcacacataaagctaacaaaaatcagtaaaagtgcggtacaattcgcaagtttttcacttttaaaacgtggcttatgaactatcaaacatacattcctgatgaatatactatgtgtcaatttggtaaaaagttgatacatagtattgctcaaatcaaaagtaacaaaggaataaccctttatttacaaggtgatttaggagcaggaaaaactacgttaagtcgaggaatgatccaaggtatagggcataccggtaatgttaaaagccctacttataccttagttgaagaatatcatcttggtgaaaaagatatttatcatttcgatctttaccgccttagcgatcctgaagaattggaatttatgggcattcgagattactttaatgaaagatccatttgcttaatcgaatgggcagaaaaagggcaaggcatattacctgagcctgatttaatcgttcatatcaattactttgatgatgcacgtagtattgaattacactctatatcagaacaaggtcatttaattattcaacaattagtttaaaccatgaattacttacaacgcttgattttcattattttagcgattttcgcctttaatcatgcttttgctcacgtttggacaattgccatcgatcccggacatgggggaaaagaccccggtgctattggacgtcgtctcaatatctatgaaaaaaatgttaccctttccattgctcgtgaactaaagaaattgttagataaagatcctcactttcgtgccgtactcacacgagaaggcgattattatatttcagtctctaaacgctcggaaatcgcacgtaaacataaggcaaattatctcatctccattcatgccgattcatctgaatcaagtttattacgtggtgcatcagtttgggttttatccaatcgccgagccaatagcgaaatgggacaatggctggaagatcatgaaaaacgttccgaattgttaggcggtgctggtgatgtcttagcttcacataaagaaaaatatctggataaaactgtattggatctgcaatttggacatagccagcgtgttagttatgaacttggttcagttgttttacgtcactttgctcgtatcgcaaaattaagtcgtagcacaccgcaacatgccagtttaggcgttttacgttcccctgatattccgtctattttggttgaaacaggttttctttccaatgcagaagaagaaaaaaaattaaatacccttgcctaccgtaaaaaattggcaaaagttatttatgatagtttagtagaatatcgcaaacgcaatttaaaagtagatctcaataccacaaagaatacccgccaaactaaaccaaataccaacagtgcggtagataatacaaataaaacacccgttaaagacagcggtattcgtcataaagtaaaagcaggcgaaggattaacgaaattagcaagaatctataaagtgaatattaaagatattatcagtttaaataaactcaatcgtaatcaactttggcttggtgaaataataaaaattcctgctaacaatgaaaatacaccaaaagagaaagmgaaagcgaaagagaaaaagaaagctaaagataaaaatgcaacattccatatagtgaaaaaaaatcaaacactctatgcaatttcacgtcaatacaacattcctgtgaaaactttgctcaaactcaatcccaaactaaaagatggcaaagtacaaacagggcaaaaaattaaattacgtgaataagggctaagcaaacgtatgacaattaaaattcttcctccacaactggctaaccaaatagcggcgggcgaagtggtagagcgtccggcttctgtcgtcaaagaactgattgaaaacagcttggatgcaggagcgacacacattcaaattgagattgaaaatggtggtgcaaatttaattcgtattcgtgacaacggcataggaattgcaaaagatgaactccatttagcccttgctcgccacgcaacaagcaagatcgccagccttgatgatcttgaaatgattttaagtttaggctttcgtggcgaagcacttgcaagtatcagttcagtttcccgtttaaccttaacctctcgtacagcacaacaaaatgaagcatggcaagtttatgcacaaggtcgagatatggaaaccagcatcacacccgcttctcatccgattggcacaacagttgaagtagcaaatttgttttttaatacgcctgccagacgcaaatttttacgtacagacaaaactgaatttgcacatattgatgaagtaatccgccgtatagcgttggcaaaacctcaagttgcttttacgttgacccataacaataaattaatacaccgctataaaagtgcggtaacaaatgagcaaaaaattaaacgtattgcgactatttgcggcaatgattttatgcaaaatgcgttacatattgattggaaacataatgatctgcatctttccggttgggttatacaacctcagtttgctcgtcatcaaaatgacctcaattattgttatattaatggcagaatggtgaaagataaagtgattactcatgctattcgtcaagcttattcagaatatctgagcaatgaaaaatatccggcatttgtattgtttattgatctcaatccgaatgaagtagatgtaaacgtacacccaaccaagcatgaagttcgctttcatcaagctcgtctaattcacgattttatttatcaaggcatgacaaatgcactcacctctgaacaaaccaatattccaatacagagtgaacaatccaatccaaccaaagttgccgaacctcaaggtatttggaacttgaccacgcataacaaaggtaatcgagcgactgccggcaaaaatatttttgcccagcaacctaaagattatgataaaaaatcgtctcaatttaaaccgcactttacagcaaattacagcgaagtaacgccaaagaaagcagtgcaaaaagcctatgtagaattactcgcaacacatgaagaaaaaactatcgcctcttctactctaccccatcaatttacacacaatgcaacgtatatcagcgaacagaaaaatgttttacatgctcttgcattaattgaaaataaggcattgttattgcaacaaaaccaacaatatttcctcctttctattcaggcattgcagcatttcaatatccgtttacagttgcaacaaagtaatattgcacaacaaacattgcttattccgattttattgcgtttaaataaacaacaatatcaatcttggcaacagcaagctctattttttcaacaaagcggtttcgattttatagaaaattctgcacaacacagaataactctaaaccgtttacctatttgcttgcgtacacaaaatatacaaaaaataattttacacttattggatcaacctcatgaaaaatacactatttttcttaccgcactttgctcacacttggaatttccctcgctcagtactttctccgaagctgtaaatttactcacaaaaactgagcaacaattttcaacccaacatcaaccagaattccaatctttattagtcaaaatagagtgggatcactatttagataaattgcaatgaataaaaaatcaactgctatctttttaatggggccaaccgcttccggcaaaaccgacctcgctatccaattacatcaagaacttcctgttgaagtcatcagtgtcgattcagctttaatttataaaggcatggacattggtacagcaaagcccaatgcacaagagttggcaataacacctcatcgtctaattgatattaaagatccaagtgaaaattattctgctgcagaatttcgtcatgacgcattacaagaaatgcaaaaaatcacacaacaaggaaaaattccgcttcttgtcggcggtacaatgttgtattacaaagccttattggaaggactttcgccgcttccttcagcggatgaaaaagtgcggttggaaatagaacaaaaagcagaaaaatttggttgggcaacactacacaacgaattagccaaaatcgacccaatatcagcacaacgtataaatcccaacgacagccagcgaattaatcgtgcattggaggtcttctatttaacaggacaatctttaacagaattaaccgcacaaaaaggcgaagaaattccttatcacatcatacattttgctatcgcacctgaacgagctgttttgcaccaacgcattgaacaacgttttcataaaatgatcgaacaaggctttcaacaggaagtcgaaaaactttatcaacgctcggatctacaccctaacctaccctctattcgttgtgtcggttatcgacaaatgtgggaatatttacagggtaattatggtaaagacgaaatgatatttagaggtatttgtgccacaaggcaattagcaaagcgacaacttacatggttgcgtggttggaaatcgcccatagaatggctagacagcctaaacccaaaaagtgcgaaagaaaaaatcataaaaactataaaacataactgtaaataaagttcacaaaatcgtttttttctataaaaatttaggataaaatggctcgaatttttacttgacaaataaaatagaatagaaaaaatgacagcctacagcctacagcctacagcctacagcctacagcctacagcctacagcctacagcctacagcctacagcctacagcctacagcctacagcctacagcctacagcctacagcctacagcctacagcctacagcctacagcctacagcctacagcnnnnnnnnnnnnnnnnnnnnnntacagcctacagcctacagcctacagcctacagcctacagcctacagcctacagcctacagcctacagcctacagcctacagcctacagcctacagcctacagcctacagcctacagcctacagcctacagcctacagcctacagcctagtatattggctaaaatcaacctttcaagttaattttgagaggttggacatgttcaaacaatatcttaaaaatcacctatttcaacctcaacctttcggcgaaagtattattcgcctttttttgttgtgtcttaaaaagcaaggcatcgccgatttatttatcaatctatctaaaaagcaaaacgtttaatcaataaacaaccgtaaaaaagttwaaaaaatcaacaaaataaatcaataaaaaaacctaattttaaaagnttaaagagagtgaatttatgaacaaaatcttcaaaaccaaatacgatgtaacaacrggtcaaacgaaagttgtgtctgaattagcgaataaccgccaagtggcgagccgtgttgaggcgtcggggcgtcagccgaagtgcggtgtgtttttaggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaatgtccgctattgctataggaactagtgcaacagctaacgctcaaaatagtgtagcgttcggaaatgaagctcaagtaagcatggaaaattcggtagcattagggagtaaatcacatacaaaatatttctatcaaaatgataataacaaaaacacagccacgctcatcggaaacggcacaaatgatgcgattaatttagatccctatgttccagaaggttctagctataacttaaaaaccgataaagcggcgggtattgtgtccgtcggttggacaaaggataacggcaaaacacaagaactgggcttaagacggattgtcggggtggcaccgggtgcgttggactctgacgtggcgacgattggacaattaaaagccttagaatatgtaaaaagagaaggcttagtcgtttattatacgcaagataatggaaaaatatataaattagttaaaggaacagatggcaacttctataaggtagatacaaaatatggaacaccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatggagagatttccaacaaatccgatcaagcgattactggggcacaacttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaattyaccatcggyttaammganrmyccagaatttacgagtgtaaaacttacarsyrmtcctacagagaacactcacgccgttaataaaaaatacgttgatgacaaactcaaagacgtggcttcaaatatccactttatgtcagtaaaagccccgaccacaacaccaaaatcaaaaggcaactatagcaacgacggtgcaaaagctgagggggcgattgcgattggtgtggacgcaagtgccgcttctgaaaactccatcgctatgggtaaaggctcgaaaattgaggcggaaatatcgaacgccgtcgctatcggggcgaataatcatctcagagggaagaataaaggtcaagataagcatacggtggctattggttcagacaatatcatcaccggacgaaaaatcgtgaatttaggttcggggaataagataggtaatactgataataattataaaagwgttaaaggagcaggtgcggtcagcatacgagtgatcggggacgataataaggttcatggggtatggaataccgtcatcggcgaagggaataaatttacagattcctcagtctatgttcatttgatgggtgataaaaataccgtcacagattccaaaaataccatcatattaggcgataacaatactgtctcaaaattagcaaactctatcattattggtaaaaacataactgctaaatctaatgttaaaaacaataataatttaatcgtcatgggtaaccaagcccaagcaacaaatgcgaataacagtgtggtgatcggagcgtctgcaaaatctacagcagtaagtgcggtcgtgattggacaaggttccgaatccaaagccgaaagtgcggtagttttaggtaaaggggcgactgttcaagctaacgccgcaggtgcggtagcgattggtgaaggggcgtctgtatctacaaatgctggtaattcgattgcgttagggaaaggatcgcaagcgacggctaaagcgaatgcaaaggcaaatgctactgtagagggcgtgaattttgcctttgcaggtgggactggaaataataagacagtattaagcataggtaaagctggaacagagcgtgtcattaaacacgtggcagcgggcgaagtgagcaaaacctcaacagatgctattaacggaagtcaattgttcagtgtgacaacggaatttgcaaaactggcaaaagatgtccttggggcggagttaggcacaactaatcaattcaaaaaatcaaaatttaagacattaaaagcaagtagtagtggtgcggatacaccacaaraaaaaacatttagagaagcgattaatgcaaatatagaccaaattaataaaggcttggtatttagcgacggcacaacgcatggcacaagacagctgggcgaaaagatcaccatacaagccggcaatattgacagcggtgattttgtcagtgacaacataaagacgaattacggtaaggaacaaggaaaattcctgattgggattaaaaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaagacaaaatagacaatgccttaagtaaaaccgatgcagggacagcttatgcgaaagtagatgcttctaatataaacaatggtaatcaaacagcatggagaacggcactagacgtctattctaaaaccgaaacaacgaatgaaatcgccaaagcgaaagaaacagtcacaaatggtgagggaattacggttagagaaacggctgctggaaacggagctaaaacctttamggttgcattagaaaatagttataaaaccaaaattgatggcattggtactggaactgtatcagataaaaatgacaaaaccgtaacgggcggtgctgtacatactgctattgaggcggcaaaaactgatttgaaaggggatctttatgacaagaatgcaacatttggcttaaaaggtaatgatagtcaagaagttaaaaagacactaaataatagtatagaaatcaaaggaagtgaaacggctagaactagtggcacaaatatttatgtatcaaaaaatgatgaaaacggtctaaaaatcgaattgggtgaaacgttaaaaggaataacttcgattactaagggcgataataagtctaaaatcgactttaaagatgacagtattgatttaatgccagttaatggaaaaactgtctctataacaaaagacggtaaaatcagcggcttatcagatggtcaaattgagaacgcctcaaaagacgtggtcacaggaaatcaattgcatgatctagcgggtaaattaggcgttagtgtggatacaaattctaaaaccggttttaccgcaccgtcgtttgtcgccgtcaattatcaagggcaaacagaaactaacggaaaaaccacctttaaagaagcaatcaatgatttgatcgtggctgtgaataaggggtttgtaattagtgatggaaccgataatggaacgcttaatctaggagatacattacaaattaaagcgggtaatatcgataaacctgatgcacaaaccttaggatttaccagcgataacattaaaacaaaatatttatcaaataaaaaagaagtgttaatcgggattaaagaaaatccgaatttcaaaacggtaacagtaactgacacaattgatgaaaaaacgccggaaaatacgttgatcacgaaaaaatatgttgatgaaaaattagccactaaagcagggacatttaacgtgagttcggataaaggtgacacaaacaatatcaccggcactttatctgtcaaaggtaaagaagatgatgctaatggcaaacatcaaaatattaaaacagaagcgacaggatcgaatttaacgatagcacttaatagcgacttaaaaggtatatcggctatcggtaaagacgataaggctaagattagttttaataaagatactgctaaaaatgagatcgagtttagtttgggagataacacgaaatataaattcgatgagaatggattagayttaggwrgyaaaaaamtcaccammcttgcragcggtttagggttgamagakgctggtactggaaacggaaatgccgacattattaaaaaagtcctcgcgggaactcttgataatggcagtaacattaaatccactaacgccgtcaatgtcaaagacctgtccgaagtcgctaaagcccttgtgraaaaaggactttcatttgaggggaaygrtggaagtagtaataaagttactcgcaaactcggtgagacgttgaaaattgtgggcaaaggaagtggtgctaactcaataacaaccactaaaaataatattaaagtgtctaaaaatacagcaaacgatggactggaaattggyttgtctgatactttaacagsyattaaatctattgsyaatggcgakaatgcgaaaattactttaagcggaagtaatggaagcaaggacaaaattascttcaaagcaggtagttcagaggttaccctagccgatggtaaatttagcggygtktctgaaattaataaagaatcaggcaaagctgcgttgaaacttgaagccgacaaagcgaccttagaaagtgctagcggtaattccaaagtggaattaaaagataaagcagtaacmattacagctaaagaggataaaggatcgttaaaactcaccgaaaacactgcaaccttagaaagyrcgaaagacggytcaaacstkrcwttrgatrrtacyagtgcaacgttaagtgckggtaaaaataagggyagtattaaagttacyaatggagcggataacaaaattgagttaagtccggaaaacggctcaaccgttacgttgaaaaaagacatgacaaatggcggagtgcaagccaccggcttgtctaccatcggtaaagatgagaataacgctttagtgtttaaaaacggtacgagtggcacaaacacggcagagttaaaagtgggtggtgcgacgttaaaattcacgccaactggaactggaataagtggaactaaccaaacagtgaaaatctcaaatgtggcggttggtaatataacgactgattcaaaagaagctattaccggcggacaacttcatgatttagcaggtaaattaggggttgaggttgacagtgggaaaactgcgtttacagcaccatcatttaatccgataaaaggtggtactaaagacactaatagtggcacgactacggctgccccaacaacctttaaagatgctattactcagttaatcaccgctgtgaatggcggcttgacctttacaggaaatgatacttcccaaagtaaaaccacattacaattaggtggaacattgaccattgatagttcnnnnnnnnnnnnngaaaaagacatcactacaaaactagaaccatcgaatggtagcgactctaaagataacggtacactcacgctgactttaaataaagcaacatctgtcgatgaaaatgatgaaaaagtcattacctcaaaagccgtagcaactgagctggaaaaatatacgaaaactgctgatttaggtaatacgtatttgaaaatagacgggtcgaatataggtgatgctgaaggtaaaaaaacatttggtaataatgtcggtattgctgaaatcaaactcggcgaaactgacaagagcgacactgaattggtacaagctaaagccttaatcaactatctaaaaggtacaggtcaaaaatccgttaaagtatccgataatccagaaactaaggctgaaggagactattctattgctcttggcgataaagcggtagcacaaaatgaaggtgcaattgctatcggttatggtgctaatgctaaaaatagaaacgcacttgccatagggagagatagtgatgtattaggcgagcatgctacggctattggttacaaaaataatgtatcgggcaatcattccggtgcattcgggaaacaaaacacggttagcggaragcattcctatgctgtgggtgcttataatacgctagctggcgaacacacttatgtcttgggttcaartrtcacgacagaygacaargtaaaaaatgcygtyatyttaggtaataactcaaaaggtgagaaagatgcggtrtctgtgggtagtgatacgcaacaaagaagaattgtttatgtcgccaatccaaaaaatcaacacgatgcggtgaataaacaatatgttgatggacttggattaaatttcaaaggtaatgataatcaagagatacacaaaaaattatcacaaactttagaaatagttggtaagggtttaaataaagctcaaactgctaaatttaaaggaacaaatggaaatattgccgttaaatcaagtagtggtaaagataaaaaattagaaatatctcttaatgagaaattatcaaatattaaaacaatagaaaataaaggtagttcaatagaatttaatgcaaatgataaaaatggatctagcaaaacaattaaaaatttacttcttacaggaaatggaacaaaaatggttctttcttacaaaggagtacatttaaatgaaaaacaattgattggactaaaaagtggactattagaaaaacacaacggaaaagatcaagaaagaaaaggtttagacgatttaatagaaaattttgataaatcatcgattaaaactcatgccgtcaatgttggagatttagcgaaaatttctaaggaaatagttgaaaaaggatataagtataaagctgatattccgtcaaataatagcaatgataccagcataaaactaggctcaaccatatctattgttaaattatccggtacatcaacaaatggagtaataacatcttcacaaccgagtacacctacaataaatattggggactataaaggagataacctaatcactcgatataccaacgagagtggaaacgctaagatcgaaatcgggtttaaagacgcaccgatatttagcaaagtgacactttctacaccgcaaatgtatggtaatggtacaggtagcggaaatgctgttagtgataacgatttgatcaccaaatcctaccttgatgccgcattaaaagactttaagtttaatgtggaatatggtggtaagaaagtccaaatcggtcgcggcgacaccttgaaatttaatgccgggttgaatattaaagtagagttagctcaaaatggtactacacaaccaagtgcgggtagttctgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttcaagcactgctcagtcaagtggtgcaggtacaaatggcaaaagtggtacaagcagtacagcttcgtcaggagctactccaagtacgacaacagccggcacagcaagcagtacaacatcgaacactacagcggtggtgacgattggtacgactgaggacttgacaggtttgaaatctgctgagtttaacggcgaaagcggtaacacgactaacattaccggcaatgaaattgtgttgaaagatcaggcaggtaacgctcatacacaaacggcgacatcgcaaatcatcacggataatacagatcccgataaggaaaaagcggttgtgacaacggctgagggcgtgacaatgtctgtggtcagcgatgatcaggttttggtcaatgatcaaacagcagaagcgaatgttttaagcaatggcaagcacacgacagaggtgaaagccggcgaggtcgctattaaagacaagagtggtcaagaaatcgtgagcttgaaagtggcagagggtgaaaacggtcaagatggcaagggagctacgctggcgtttgctaaaggcactgacggtaaatcgggcactggcgtaatcacgggcttgaaagacctagatgccacggctgacggttcaagtgcggcgaataaaaactatgtggatgaaaaagtgtccgatttggacagcaatcgaccgtttgacttctatatccaagagggcgatgactataccaaagttgtcaaaggacgtgatggtaagttctatgatcctaaagagttagagggggcgaagtatgatgcagaaagtaaaaaatatacttctcaagatggacaagaagttacaccggaatcggataaagtcattattcgtgccgaaccgactgccgcacctatcgggatgaataacgtggcgagtggtttgggactggcagatcctgaaactgatccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagaaaaattacggaggctatgaaaaagttgcagagttagtgaaacmggatagcmaaryagakttaascaacgyagcmacmatygstgayktgcaagcggtagcgaaatcgggcwtgaagttcaagggcaatgayggtgttgaagtgcgkaaacaactcagcgaaaccttagmaattamaggtgaagaaaatgcaagtgacgagaagtttaacagcaacctcaccgccgccggcaatatcaaggtggaaatggcacaagacggcaagggcttagtcgtcaaactgtccgaccagttgaaaaacatgacttcgtttgaaactcgtgaagtggacggtaagaaatcccgcttggacagcaacggtttacaagcgagcagtctagacagcgaaacttttgtaaatgcacagggtacccgtattacgggtaaaggaaatcatgccggtcaatcggcaagttacaccctcgatggcatggcgatcaccggtaataatggaagcgtgcagttgaatacgaccgctctttcctttgcaaccactcgagaccaagcgggtaaacctgtcggtacaggggttatccgaggtctgaaagacttggacgcacaggctaccggtgatatggcggcaaataaaaactatgtggacgaaaaagtgggtgctgccgtcaatcgcttggataatgtcatcagtaccaacaaccgaaccttacaggcaggtattgccggtgcgaatgcggcggcggcattgcctacagtaacgatgccgggtaaatcgaccattgcgttgtccgcagggacttacaaaggcagaaatgcggtagcgataggctattcacgtctaagcgataatggtaagataacgctgaaattacagggcaacagcaactctgccggcgatttcggcggtggcgtaggtgttggttggacatggtagtctagtttaaccgctataaaaaagcagtgagtaatcactgctttttttatgataaaagtttcaccgctctttttagtttttgacgttcgacaaaatcgaaaagaaaatcctgttaaattaattacccttgataatgtccgacgcccagctcgtcttctttacgagtgcggttaataacgacttgcggagattgaacaatacgtaaccccatttcatcttcggtacgaactacctcacctcgcagagaattggtatagacatcagtaattttaatatctacaaacttaccgatcatgttaggcgttcctgcaaaattaactatacgatttgtttccgtacgacctgttaattccataatatcttttttcgatggaccttcaaccaatacacgttgctctgtccctaacattgctcgactaaattgtgctgcttgattgttaatgcgttgttgtagcaaatataggcgttgttttttctcttcttccgttacatcatcaggcatatctgctgccggcgttccgggacgagcagaataaataaagctaaagctcatatcaaaattcacttgagcaattaaattcatcgtgtcttcaaaatcctgatccgtttcccccggaaacccaacaataaaatctgaactaatctgaatattcggccgcacttttttcaatttgcgaataattgatttatattcaagtgcggtatgatttcgcttcattaaattcaatacacgatctgaaccgctttgcacgggtaaatgtaagaaactcaccaattcaggcgtatccgcatatacatcaataatatcatcagtaaattcaattgggtggctggtggtaaaacgtaatcgatcaattccatcaatagaagcgactaaacgtaataactcagcaaatgaacaaataccgccatcatgtgttggtccacgataagcgttcacattctgccccaataaattgacttcacgcaccccttgctctgcaagttgtgcgatttcgaataagacatcatctacgggacgacttacctcttcacctcgagtataaggcactacacagaatgaacaatatttattacagccctccatgatagaaacgaacgctgtcggtccttccgctctcggttccggtaggcgatcaaatttctcaatttcaggaaaacttacatcaaccaccgcactttttccaccacgaatttgattaatcatttcaggtaggcgatgcaatgtttgtggtccaaatacaatatcaacataaggtgcacgtgaacgaatatgctccccttcctgtgaagcaacacaaccgcccacaccaattaccaagctcggattttgtttctttaattctttccaacgacctaactgatgaaacactttttcttgtgctttttcacgaatagaacaggtatttaataacaatacgtccgcctcttcaggcacatcagtcagttctaaaccatgggtatttaaaagcaaatctgccatttttgaactatcatattcgttcatttgacagccccaagttttaatatgcaatttttgtgtcatgtcagtatttaaaattcatttctaagtaaaaaatcagtcggtcattttacagagttgttgcacctgttaccagctaaaaatcagattttattttttaaatttagccaacagagctaaaatagagaaaattagtttgtggagaaaataaatatgcaaaaagacattattgttgttggcggcggcatgattggtgcggcttgtgcgacaggattagctcaattaggattacagatccacgtcattgaacatcattctctacctgaatttgatccgacatcggattatgacattcgcatttctgcaattagtgttgcatcagttaatttattaaaaacccttaacgcatggcaacatatcgaaaaaatgcgtatttgtccttatcgaggactggaaacttgggaaattgagggatttgccacaaaatttcatagtcaagatttacaactgccggagcttggatttatggtagaaaataatcttattcaactgggattatggcaaacattttcttcataccccaatattactaccagtgtgcaaaattctattgaacatgttgaaaagtgcggtaaaaattggcgtatttttttatctaacggagaaagttatcaagcaactctcatcattgcagctgatggtgccaattcacaattacgccaaattgcaggtataggtttgacaggctggcaatatcggcaagattgtatgcttattttagtgaacacagaacaagatcaacaagatattacttggcaacaattttatcccagcggacctagagccttgttgccgttacaaaataagcaagcttgtttagtttggtatgacagcccacaaaaaatacgtgaattaaaacagctaccaaatgaaaaacttgcggaagaaattcatcaatcgtttacccctagactgggcaaaataaacgtacaaaaatttgcgacttttgcactaacacgtcgtcatgcacaagattatttcaaacaaggtattgttttagttggcgatgccgcacacacgattaatcctcttgccggacaaggtgtcaatttaggttttaaagacgtcaaagtcctgcttagtgtaattgaaagtgcggtaaaaaataatgaagatttttcagcggatcatgttttacaacgttatcaaaaccgacggaagcctgataatttactgatgcaatcgggtatggatctgttttataaagccttcaaagaagatagcatgccattaaaaatagctcgtaacttggcattactgggtgcaaacaaaataacgcctcttaaaaaacaagcgttgaaatacgcacttggtttgtaaaaaatcacctaaaaatgaaatcatcactttcaattatgagctaatcgctatatcattagccattcaaaactaagggcgcttgcaattttattgtgggctttttatttctactcaatacctgaacaaacgcaggttcattagggagaaaaccaaagctagtggaaaatacagttcaaaacaagcctattattgagcttcgttctcttactaagtcttatgatacaaaaaccattatcaataacttcaatttaactattaataacggtgaatttttaacaattctaggtccgtcaggttgcggtaaaacaacagtgttacgtttgattgccggttttgaagagttaaatgaaggtcgtattattcttgatggtgaagatgtgacggatataccggcagagcgtcgtcacataaacaccgtattccaaagttatgccctgttcccacatatgacgatttttgaaaatgtggcctttggtttacgcatgcaaaaagtaccgaatgcagacattaaacctcgtgtaatggaagcattacgcatggtgcgtctagaagaaatggcggatcgtaagccaactcagctttccggcggtcaacaacaacgtgtcgccattgcaagagcggtagtaaataaacctaaagttttattgcttgatgaatctttatccgctcttgattataaattacgtaaagaaatgcaaaatgagttgaaagcattgcaacgtcagttgggaattacctttattttcgttactcacgatcaggaagaggcattaactatgtcagatcgtattatcgtaatgaacaaaggcactatccaacaagatggttcaccacgtgatatttacgaggatcctaaaaatctatttgtggcaaaatttatcggtgaaatcaatatttttgatgcgatagttattgagcgtacagacgaaaaaactgttaaagccaatgtagaaggtcgtgtttgcgatattcatacagagttgactgtccaaccaaatcagaaattaaaaatcttgttacgtccggaagatattataattgaagaacttgatgaaaatgaaagttccaaagcaattattggacatgttgttgatcgtagctataaaggcatgacattagagtcaagcatcattcttgatcataataaaatgaaagtattggtgagtgaattctttaatgaagatgatccgcatatcgatcattcagtgggtcaaaaagtggcactaacgtggcatgaaggctgggaggttgtactggacgatgaagatgaacagtaataaatttcaaaacttaactgttagtgtcattttcggctggttactcttctttgttttagtaccaaacctgctagtcttaacagttagttttctatcaaaagatagcagtaatttttatgctttgccttttagcttggaaagttacgcaaacttagttgactcacattacgccaaagtaatgtggaattcactccgtatgtctgcgattgcaactgttatctgtttacttgtaggttatccttttgcatttttcattgccaaaataaaaccctcataccgtccatttttgctattcctcgttgttttacctttttggacgaattcgttaattcgtatttacggaatgaaaatctttcttggtatgaaaggtattttaaacaataccctaattgcaatcggtattattgacacaccaattcgtatcttgaataccgaaactgcggtaatcattggattagtttacatcttactgccttttatgattttaccgctttacgctgccattgaaaaactggatcttcgtttattggaagctgcaaaggatttgggagcaaattcatttcaacgttttattagaatcattattccattaacaatgccgggaattatcgcaggttgtttgttagttctattacccgcaatgggaatgttctatgtgtcagatttgcttggcggagcgaaagcagccctagtaggtaatgaaatttacgtccaattcttaaaaataagaaactggcctatgggttcagcaattagtatagcacttactctactaatggctttattaatttttatttactataaaacaagtaaattattaaataaaaaaatggagttggaataatgagtcgtttactacgtaatatctttttgtttgtggtatacgcttatctgtatatcccgattattattctaatcagtaattcatttaacaatgatcgtttcggtaatacttggaaaggtttcggtttccaatggtatgagcgtttattcaacaacgatactctcattcaagccgctattcattccatcactattgcattttttgcagcatcattagcaacaattattgggacattaactgctatcgcactttatcgttatcgcttccgtggtaaacaagcgataagcggaatgttgtttattgtgatgatgtcgcctgatattgttatggcggtatccctacttgcattatttatgatggtgggtatatctctaggattttggtcattgcttttagcacatgttacattctgtttaccttatgttgtagtcagtgttttctctcgtctaaaaggttttgataacaaaatgttggaagcggcaaaagatttaggtgccggtgaagtaacaatattacgcaagatcattttaccgttagcgttgcctgccattgtttcaggttggctacttagctttaccatttcattagatgatgtagttgtgtcctcatttgtcagtggtgtaagttatgaaattttaccattaaagattttctccttagtgaaaaccggggtaacccctgaagtcaatgcactggcaacactaatgattattttctctttaatcttggtaatactcagtcaacttgttgccaaaaaagggaaataataatattccaaaactgtgaaataatatttcacaaatgatcctatatcacataaaataacacgccctactttcggtaaggcgtttttattccttcaacaccgaagtatattccgcatgttaaaagtgcggtcgttttttactcttatattggagaacaatagaaatgaaaaaattttcaggtcttttcacactgggaatgatcgctgtagctctagcggcttgtaatgataaagatactcaaaaagcagagactcaagcacctgctgcttctgcaggtgatactgtttatctttatacttggacagaatatgttcctgatggattattagaaggcttcactcaagaaacaggcattaaagtcaaccgttcaagtctagaatctaacgaaacaatgtatgcaaaaattaaaactcaaggtgctgccggcggttatgatgttattgctccatcaaactactttgtttcaaaaatggctcgtgaaggtatgctaatggaattagaccacagcaaattacctgtcatcaaagaattaaacccagattggttagacaaaccttacgataaaggtaacaaatactctttacctcaattgttaggagcaccgggcattgcatttaatacaaatgaatataaaggttctgacttcacatcgtgggctgatttatggaaacctgaatttgccggtaaagttcaattattggatgacgcacgagaagtattcaatatcgcattgttaaaattaggacaggatccaaatacacaagatcctaaaattatcgaacaagcgtatgaagagttattaaaattacgtccaaacgtactatctttcaactcagataaccctgctaattcttttatttcaggggaagtgagtattggtcaattatggaacggttctgtacgtatcgctaaaaaagaaaaagcacctttagatatggtattcccgaaagaggggcctgttctttgggttgatacgttagccattccatcaacatctaaaaatccggatgctgcacataagttaattaactacatgctaggtgcaaaaacagcagcacaactcaccttggaaattggttatccaacctctaatatcaaggcgttagaattacttccggctgaaattactcaagatccggcaatctaccctacagctgaagttttacaaaacagttactggcaagatgatgtcggtgatgcagttcagtattacgaagaattctatcaaaaattaaaagcggcaaaataatctttgcgcacaaaagaaatgctcccatcggagcatttctgttttgaaaataagcttaagctaaattcccaactaaatttttcacaaattccaaccgctctttatgtgacgtcaatgacttactaaacctaaacttagtcggtccgtcaaatttaaatacagtaggctgagactgaattaattgcacaaatttcatcggatcaagttctgcattttcagaaaactcaataaatcccccattaattgtgctatcaattttgacaatttttaaggtttttgccagcaaacgtaactcagcaatttgcattaaattcttacctgcctccggtaataagccaaaacgatcaatcaactctactttcaattcatctaactctgcctgattttccgctccggcaatccgtttataaaaagataatctcatattcacatcaccaagatattcttccggtaataatgcaggtacacgtaaatcaatctctacttgctgttgtgttaaagtatccaaagaaggttctcgcccttcttttaatacagcgacagcattttccaataattccatataaagcgaaaaaccgatactttcaatttgaccgctttgctcatttccgagcaattcaccggctcccctaatttctaaatcatgggtagccaaaataaatccggcacctaaattatctaaactttccagtgcctctaaacgcttaacggcatctttggtcattgcttttggatgaggtgtcaacaaataagcatatgcctgatgatgagaacgtccaactcttcctctcagctgatgtaattgggctaatccaaaattatccgcccgttcaataataatcgtgttagccgttgggacatcaatccctgtttcaataatagtagagcaaaccagtacattaaaacgctgatgataaaaatcggacattacacgctccaactctctttctcgcatttgcccatgcccaacaaccactctcgcttccggcacaagtgcggtcagtttttctgcacaattttcaatacttgccacatcattatgtaaataataaacctgtcctccccgtaaaatttcacgcaacacagcttctcgaataatcaaatcgtctacctgtcttacaaaggtctttatgctcaatcgtcgtgccggcggtgtggaaataattgataaatcacggatgccactcatcgccatatttaatgttcgaggaataggtgttgctgttagggttaaaatatcaatattggttcgtagctgtttgattttctctttttggctcactccgaaacgatgttcttcatcaataatgagcaacccgagatcgctgaattttacttctgactgaattaatttatgcgtaccgattaaaatatcaattttaccttcattcaagtgttgtaaaatttgtttctgctcttttgccgttctaaaacgtgacaacatttcgacattaaccggcagattggcaaatcgatctttaaaattttcataatgttgctgtgccaataaagtcgtaggaaccaaaaccgctacttgtttatggttcatcacggctaaaaatgccgctctcattgctacttccgttttaccaaaccccacatcaccacaaactaaacgatccatagctttttcttggcacatatcagaaataaccgcattaattgccattttttgatctggtgtttcttcaaaaggaaacgtggcagtaaattgtttaaattcttctttatcatattgaaatgcaaagccttttttaacttcacgttgagcataaacatccagcagttcagcagcaacatcacgaattttttctatcgccttatgtcgagcctttgcccaactatcattacccagtttatgtaaaggtgcattttcatcagatccgccaacatagcgactaattaaatgcaaagaggtaacgggtacataaagttttgaattattcgcatattccaataataaaaactcagctttaattccaccattttctaaactcaccaatccaccatagcgtccaacaccatgctctaaatgcacaacaggttgtcctatttttaattcagcaagattgcgaatgagtgtatcgggattggcaactctacgtttattacgctcacgttgttgcactcgctctcccaataattcagtttcacaaataatggcaaccttatcctcattatcaataataaatccatgttctaaactactgatgagcaggcttttagctggcttatctttttcacccaaatcctgaatttgcgttggtttgagctttaaaggtaagagtaaatccaataatgtttcccgacgcccttctgtttctactgaaaaaataacagttccgtcaaattcctcaataaactgacgcaatttttgcaaaggttctttttgttgtacttgaacggttaattccggcaacggctgcacaggtaaatttttttgacgaacagaagtgcggtccaattttttactttttaaactcaatcttggataattttttaactgccgattaacttcatcaatgcgtaaccacaatttttccggcatcagcaacggacgcatcggatcaacacgacggctttcataacgttgctcaatatcctgataaaaacgttccgcttgcggcataatttgttcaaaatccacaaacaacgtattgtcaggtatgtaatcaaataaagtcgccatttgattaaaaaagagcggttgccaatattcgattccggaaactagagttcctttactgatttgttgataaatatgttcaggatctcgtctaatttccgcaaaagtttctctaaattgactacgaaaaaagtcaataccttttctatctgttgggaactcttgtgcaggtaataaattaatacgttgaatttcctctaatgtacgctgcgtatctacatcaaaagtacgaatactatcaatttcatcatcaaaaaaatccaatcgaaaaggcaccgcacttcccatcggaaataaatccaataaagcacctcgtactgcaaattcgccatgttccagtacttgttcgactgctcgataaccggcattttccaactgtaaacgaaatctttcgatatttaatcgatcacctcgttttatcaataatacattgtgttgtaaaaattctgccggacaaactcgttgcattacagtcgtaattggtgcaataaagatacctttgttgctatgttgcaactgaaacaaggcacttaagcgagctgaaataatttcttgatgtggcgaaaaattatcgtagggtaaagtttcccaatcaggaaaaaatgtaacaggttgttgagtgaattcagttaaaattttttctaaacagaccgcacttttaacatcaggggtcatcacaaaaatcaacccatcatatcgccgtacaatttctgcaatcacaagactatcagccccctgtaatacattacctagaagtttatgctcattgggctgggtaggtatgtcaaaattaaaatacatcatattcaaatggatttatgttgaaaagttgccatgtaatttgcactgacatcttgatttaaccaaaattttccggttaaaagattgtaatgataaccacaaatatttttacaaactaaatttgcttggtcagtccaatgcagtaactcagccggtttgataaatttatcataatcatgtgttcctttcggtaacattttaagtatgtattctgcacctaagaccactaatgcccatgctttaaatgtgcgattaatagtcgaaaaaaataagacaccattcggttttaataaagctcggcaagactgaatgatggataaggggtcaggaacatgctccagcatttccatacaagtaatcacatcaaatttttcagcgtaaagtgcggtttgtttttgtaaaaattcttcaacagtaatttgctgataatctatgaccagtccttgttccttggcatgtaaacgagcgacttcaagaggagcaacggtcatatcaattcctgttactattgccccttgctttgccatagcctcagacaaaataccgccaccacaccccacatcaagcacttttttttccgttagtccgttagcttgctgttggatatattgtaatcgtgtcggattaagttgatgaataggtttaaaatctccattcggatcccaccaactttttgccattttttcaaatttttctaattcttgcggatcaagattttgcatttttatcagtccgtatagcagtaaaaaacaattacgctattattccttaactgcgttaaaaattcactacaaaatttcgagaaaatcagaagttatgctataatctcgccaatttttcgtacctaattaggaaatctcaatgactgattttacccccaacgttactcctgtgagtatagaagaagagcttaaatcttcgtatcttgattatgcgatgtctgtaattgtcgggcgagctttgcctgatgtacgtgacggtttaaaaccggtgcatcggcgtgtgcttttttctatggatcaaagtagcaatacttacaataaagcctacgtaaaatctgctcgtgttgtaggggacgttatcggtaaatatcatcctcacggtgatagtgcggtgtacgatactattgttcgtatggcacaacctttctcgttacgctatatgttggttgatggtcaaggtaacttcggttcggtagatggtgatgcaccggctgcaatgcgttacaccgaagtgcgtatgcaaaaaatcacccaagaattactcaccgacttagataaagaaacagtggatttttcgccaaactatgatggaaaagaaatgatccctgatgtcttgccaaccaaaattccaacattattggtcaatggttcttctggtatcgctgtgggtatggcaaccaatattccgccacataatttaaatgaagtattggatggctgtttagcctatgtggataacgaagaaatcagtattgatgaactaatgcagtatattcctggtcctgacttccctactgccgctttaatcaatggacgtaaaggaattgaagaagcatacaaaacaggacgaggaaaaatctatgttcgtgcaaaagcggaaattgaaactaacgataaaggtcgagaaaccattgttgttactgaaattccgtatcaagtcaataaagcaaaattagtagaaaaaattgcggaactcgtgcgtgaaaagaaaattgaaggcatcagtaatgtacgagatgtgtcaaataaagagggtaaccgtgttgaagtagaagttaaacgtgatgcagtcggtgaagtcgtacttaataatctgtatgccttaacccaaatgcaagtgacgtttgggatcaatatggttgccttggatcatggtcaaccaaagctattaaatttaaaacaaatcattgaagcatttgttcgccatcgccgtgaagttattactcgtcgcactgtatttgaacttcgaaaagctcgtgagcgtgcacatattttggaaggcttggcaattgccttagcgaatattgatcctgttattgaattaattcgtgcctctaaaaccgctgatgaagctcgtatcggtttattatctcaagcttgggaattaggtaatgtagcaacaatgctcagtgcaacaggcgtagatagttctcgtccggataatttggctgataacttaggtatcatcgacggtaaatactatctttccgatgaacaagctcgtgcaatcttagatttacgtttacaacgcttaacggggcttgaacacgaaaaaattgttactgaatatcaagaaatattaattgaaattggcaaacttttacatattctaaacagtgcggatcgtttgaaagaagtcttgtgtgaagaactggaaaaagtaaaagaagaatttggtgatgcacgtcgcactgaaattacatcggcatccggcgatattaatttagaagatcttattacccaagaagatgtcattgttacactttctcatgcaggttatgtaaaatatcaaccgcttacagactatgaggcacaacgccgtggcggtaaaggtaaatctgcaactaaaatgaaagatgaagattttattgagcgtttattagttgccaatactcatgacactattctttgcttttcaagtcgaggcagattatattggttaaaagtatatcaactaccgcaagcaaatcgaggggctcgtggtcgtcctattgttaatattctcccattacaagaaaatgaacgtattacagcaattctaccagtggctgcctatgaagaggataaatttatcgtcatggcaactgccggagggcttgtgaaaaaaattgcgttaaccgaatttagtcgccctcgttcaagcggtattattgcacttaatttacgtgatgaagatgaattaatcggcgttgatattacagatggtaccaatgaaatcatgctcttctcatcacaaggtcgagtagttcgttttgaggaaaatgcagttcgagcaatgggacgtttagcgacaggggtacgaggtattaaactggcattaacaaatgatatttccgatgatgaaagtgcggtagaaattgaggatatttctgatgaggatacaaaagaacctcttgatctgaatgtagataaagtggtgtcattggttattccaaaaaatgacggtgcaattctaaccgctacacaaaatggttatggaaaacgtaccgcactttccgagtatccaaccaaatctcgtaatactaaaggggtcatctcaattaaagtcagtgacagaaatggtaaagtggtcgctgcaacgcaagtagaggaaaatgatcaaattatgctgattaccgatgctggtacattggttcgtacgagagtgagtgaaatcagcattgtcggacgcaatactcaaggtgttcgactcattcgaacagcggaaacagagcaagtcgttagcttagaacgagtttgtgatactgatgaagatgaagaaaatatcgataacgattttgaatagagaacagactaaatcatcataatttcaagggcgattatcgccctttctttatgtcaaaaaaatatgactctctaccttatttatacccacttaatatgtgcttttttagcttggcattactgattattcgagggctgatacaaatggataataaatcagcaaaaatactcaatccgctattttttcctgatttactctgtctaagtgcggtcgttttttctcggattttttcataattgaaaaatcaataaaatatgtcattatttaatccctcatttctctacaaaaaagctattttccctttttggtaaagcgaatttttttgctatactcgagcactgcttttattaggagaaacaatatggaacaaatgccgaattgcccaaaatgtcagggtgaatacgtatatcacgacacaattaattttatttgtcctgactgtggaaatgaatggactgacaatgaaattgaacaacaagacgaagatcaactcatcgtaaaagatagcaatggaaatatattaactaatggcgatgatgtgcttttaattaaggatttaaaattaaaaggatcttcagaagtactaaaaaaaggcacaaagtacaaaaatattcgtttagtaacaggtgatcataatgttgactgcggcaaattattactaaaatctgaatttttaaagaaagcttaaattataactatcatgtttatctaaattggagttgttatgaaaaataaaattctcggcagtgcattaatgatcgccggcacaactataggtgcaggtatgttagctatgccattaacctcagccggcatggggttttccatgacgttagttctactcgcaggattatggttattattaacctataccggcttgttgtttatggaagtttatcaaactgcaaaagaaaaagatgtcggcgttgcaactcttgcagaacaatatttcggtttaaccggacgttttttggcaactattagcttgcttgttctgctctatgctttacttgccgcttatattaccggtggcggctctcttttatcaggccttttaacgggtattggtgatgaaaaacaaacttctcaaatctcaatattactctttaccctaattttaggtgcatttgttgtgattggtattaaaggggttgacggcttaacccgtctcttatttatcggaaaaatcattggctttattgcggtcttattaatgatgttaccaaaggcaaaattagaaaacctaggggcaattcctttagataatctattggttatttctgcaattccaattttctttacctcttttggcttccacgtcattatggggagtatcaatagctaccttgatgcagatattcgtaaaatccgtttagccattattattggaacgttaattccattatttgcctatttattatggcaattcgcaacacatggcgtattaagtcaaactcaatttgttagcctattaaaacaagatccgaccctaaatggattagtaaaagcgactagtcaaattactggaagtagcctattaggtgaggtagttcgcctattctcatctcttgcattaattacttctttcttaggtgttgcaatgggaatttttgaaggggttggtgatctattaaaacgtattaatctgccgaccaatcgcccgatactggcactcttaacttttattccgccactagcctttgctctattctatccaaacggttttatcaccgcactaggttatgccggcattttatttgccttctatgggctacttcttcccgttgctttagcttggaaagctcgtcagttgcatcccaacctaccttatagagtcgctggcggtaatcttgcattagtcatcgcatttattatgggcatcgttattatcgttatcccgttcttaatgcaagaaggtatccttcctactgttgccggataaattaaaaagagcggttaaatttttataaattcaaccgctctttctattaaattttaaaaataatgcctcacaattcatattatgaagtgttacgtttatctaaaagcaatttagtctactattttttcggtaaaacgttcaattttcgcacccaatccacgtaattttttttcaatatgctcataaccacgatcaatgtgataaatgcgatcaacgatggtttcacctatggcaatacaaccggctaagacaagactgatagaagcacgtaaatccgttgccataacttctgctccggataaatattcaacaccatgacaaaatgctgtgttaccttcaatctcagcctttcctcccatacgaattaattcaggaatatgcataaaacgattttcaaaaatagtctcggtaattttacttgaaccctctgcaaccatatttaataaagtaaattgagcttgcatatcagttggaaaaccgggataaggttcagtacgtatatttaccgcttttggtctattaccttgcatatccaatgtaatcgtattttccgtgacttcaattttagcaccggcatcacgtaatttatcaattactgcatctaaagttgatgctttagtatttttacaaatgatacgtccgccggaaatagccgctgcaactaaaaaagtaccggtttcaatacgatccggcacaatactatgctcacaaccgcctaggcgttcaacaccttctatcgtgataatatctgaacccgcaccgctaatttttgctcccatcttatttaaaaatacagcagtatcagtgatctcaggttcacgagctgcattttcaattactgttatgcctttcgctagagttgctgctatcataatagataaagtcgcaccaacacttactttctcaataacaattcgtttaccgattaattgaccatcaacaaaagccttaacataaccctcttccaatacaatttttgctccaagtcgctccagcccgctgatatgtaaatcaacaggtcttgcaccaatagaacaacctcccggtaatgaaacttgcccttgtttaaaacgagatactaaaggagccaatgcccaaatagacgcacgcatcatcttaaccaactcataaggagctacaaaatgattaatatttgaagcgtctaaatgcaccgcaccttgttcatctcgataagttaccacacctaattgttgcagaatttttaacgtggtatcaatatcttttaactcaggtacattagttaatttgacaggctcttcagctagaatggccgcaaacaaaataggtaaggcggcatttttagcaccggaaatattcacttctccatttaaacgagactgcccataaacacgaaatttttgcatatgttacttcctacttatgctacatattcaataaacgatcacgcttccaccgttcagtactgaatgtttttattgttaacgcatgaatcgcaccggatttaaaatgtgccattaaaggtgcataaatagtttgctgttgttttagtctggacagttgtgcaatttcatcgtttacaacaatgacaccaaaatgtgcattttcgccctgaacatatacttcatcgagattcaatgcttcctttaaaatttgctcaatttgctgagtttccattaatattttccactattgtaaaaaaggcttaagccaatcagataagccaaaaagatctgccaaaatttccaattgaattggggcattatgaattttttgtgaacttacttgtttttcaagctcattaataaaatcacctagcaaagcaaaaccagcactatcaatgcgattaacttcactgagctcccaaacaagttgctgaccaacaagctccgcacttgataaaagttcatcacgttgttgcaaaaaaggaagcaatgtatctcgtgataacgctcccataattcggagcgttatcttatcactatttttttctaatgcccaattcagattgttctttttcatacgttatttactactaataataattggttgtttagaaaattcttccatctcatcaatcaaagtttctataccttttttgcgtaaaataggtaaccattcctgtcttgttgagtgaaccgtactcacgccgttagcggacatatcatacacttgccacttacctgatttactgttcttacgccaataaaactctaaatcaataggtgcaacattgccgctttgcagtattttaaccggcacattcatttgatctgccgttacattaatcggctttaatacactaattttctgattactataaagcgtcaatgctttggcatattgatattcgataaatttatcaaataccgcaaagaattttgcacgttgttccggtgatgttgatttaaaataaggccctaacactaaagatcctgcataatttacatgagcatagggcatgagtccttgacgtacgatagtacgcaaataattaggatcttgtttaatcttactttggttagtatcaatggctttaaataaacgctcagatacatcaagcgttagttcataaggtgtttcttccgccatggcttgtacagcaaaaagtgcggtcattgccacaattattttaaaaaatagtttttttaacataaatattagctcctaaatctacagtgtatgaaaaattattgaacatccggttccaattgcttttgagtacttttattctctttgctgccatataagaattgcccgacaagatcctccaataccatagctgatttagtatctacaatacgacttccctcttttaacatggaagtttcaccatcatcaaatccaacgctaagggaaatatactgctcacccaacaaacctgaggttttaattgataatgaactgttatccggaatttcattgtacttttcatctatggcaattttaaccaacggtaaataggtttgatgatcaagttcaattgatgatactctgcctattacaacaccaccaactttcaaaggtgctcttactttaagtccgccgatgttatcaaaaacagcataaacttgataagattttgcttgattaaacccttgtatattcgcaactcttaatccaagaaaaaccaatgccccaataccaattaataaaaataatcccacccaaaattcatgtttaactgtttgtctcataaaaaatccttaattttctaccgcactttatttatgaacctgcaccaaacatcaacgctgttagtacaaaatccaatcctaaaacaacaagagaagcatgcaccaccgttttcgttgtcgctttactaattccctctgatgtcggaatacaatcatagccgttgaataatgcaatccaaacaacagcgatggcaaaacataaactcttaataaaaccgtttaataaatcatatccccagctaacggagttttgcatcacagaccaaaaactccctgcatccacacctttccaatccacaccgactaaagaaccgccccaaataccgattgcggtaaaaataacggcaagaatgggcatagaaatcacacctgcccaaaaacgaggtgaaataactcgacgcaaaggatcaactgccatcatttctaagctggataactgctctgttgctttcattaaacctatttcagccgtaagagctgaaccggctcgaccagcgaataaaagtgcggttacaacagggcctaattctcgtaacaatgataatgcaactaattgtccaagacttgtttctgcggaaaaatccactaacaccacatacccttgcaaccccaacaccatgccaataaataaacccgataacatgatgattaacaaagattgtacacctaatacataaagttgtttaatgagtaaagggaaatgcttcctcatctgttgtttcccaaccaatgcaccaaaaagcataaaaccggctcgccctaaagaacgacaaaaatccattccccatctacctaaagatgaaataactcggatcatgaaaacaactcctgtacatagtcttgtgcaggaaaatgaaaatgaacaggtccatcttccttaccttgaataaattgcacaacttgcggatctcggctttgtaaaagttgctccgcacttccttcagcgatcactcttttatctgcaataatatacgcataatccgcaatacttaatacttcctgcacatcatgagaaaccacaattgaagttaatcgcaacgcttcatttaaacgtttaattaagctaataatcactcccatactaatgggatcttgccctgcaaaaggctcatcgtacatgattaactccggatcaagtgcaatggtgcgagctaatgcggctcgtcttgccataccgcctgacaattccgacggcattaaatttgccgcaccacgcaaccccacagcttccaatttcatcaacacaatttgacgaataagtttttccggtaaatgtgtatgctctcgaataggaaaagcgacattatcaaaagttgataaatcggtaaataatgcgccggactgaaataacattcctatgcgttgacgaactcgatataactcactattggacattttacaaatatcttgctcatcaaacaaaatttcgcctttttcaggttgaagttgtcctccaatcagttttagcaacgtggttttaccaatgcctgacggccccataattgcagtaattttgccttgctgtacctgcaaattgagattgtcataaataattcgattacctcgcttaaaagttaggtttctgacttctattaaaggtcttgtcatagtttcttcattactctacttatatttgtacaaaatgagatcggatattccacgaatttccggtcattgtcaaattaaattatgatgattttcaaccgcacaatccaaacgagatgtctaagttaacaccccagactttaatagattattacatgcttttttaaaaactatgctatgattacgcaatttttgtcaaacacaaaacaatataaggattttatgcatattcgctggaatattattttatcggtgatagctcttgttttactcgcttggttttatactttacagccaaatgataatgaactcagtcagcttataaagtcaaatacacagccggaatacataggagaaaagatgtcaacctctgttttttcgccaacaggaaaaaaacaatatttagcgacagcagataaaattgaacactacaatgaggatagacgcacagaatttcaccaaccactggtctatttatttgatattgatgatgaaaaattcggtaagcaaagttggaaattaagtgctaaaaaagctaaattaacaaaaaataatatgctttatcttgatggtaacgttattgcagaaactttattggataatgctaaattacaacgagttatgactgaaagtgcggtagtaaatttaactactcaagacatcacctctgacacgatggttactataaaaggtcaaaatttcagctccacaggcttaaaactgaccggaaatttacaacaacaaattgcaaccttaaaagaacaggtaaaaacccattatgaaatcaacaacaaataagtatttattaattaccgcacttatgatgacttcaatatcagctttagccctaaaagatgatacaaatcaaccgatagatatcgtatctgaccatcaatcccttgatatggaaaactctgtggtaacttttacaaataacgtagtcattaaacaagggtcaattttaattaaagcgaataaagtcgttattactcgcccaacagaaaaatccaataaaaaagaaactgttgaggctttcggtaatccggttctctttaatcaattacttgataatggaaaacctgttcagggcaaggcgaataaaatccactatgatctcagtgccgaatttttaactttaacgggtaatgcggaattaaagcaactggatagcaaaattaacggtgaaaagatcacctatgatgtcaagaaacaacaactcaaagcaaatggagccggaacatccagagtaaaaacagtattaattccgactcaattcaataatcaacacaagaagtaaccgggtaaattaatatgtctatactgcatgcagaacatctcgctaaaagctataaaaaccgtcaagtggtttctgatgtaagtttaacagtgaactctaatgaaattgtaggtttactgggaccgaatggtgcgggaaaaaccacaacattttatatgatcgtcggtttaatacgccatgatcaaggaaaaattcacattgataacgaagatatcagtttgttgcctatgcacaaacgagcacagcgaggaatgggttatctgccacaagaagcctctattttccgacgattgagtgtttatgaaaatttaatggcagtcttggaaattcgtaaagatttaaatatgcaacaacgccgtactcgagctgatgagctgattgaagaatttaatatcggtcatatctgtgataatttgggacaatctttatcgggcggtgaacgtcgtcgtgtagaaattgcacgtgccttagctgcaaaccctaaatttattttattggatgaaccttttgccggtgttgatcccatttccgtaattgatataaagaaaattatccaagatttacgcaatcgtggattgggtgtgttaatcactgatcataatgtgcgagaaacactggacgtttgtgaacgagcttacattgtcagctcaggaaaaatgatagcaacgggtacacctgctgaagtcatgaataacgaacaagttaaacaagtttatcttggtaaagaatttaaattgtaattatgcttaaatttactgaattactctctcctgaaaatatccgtcaagggttaacttgtacaagcaaaaaaagagcttttgaaatcatatccagcttaattgctaaacaactttcagaacaaattgatggcttagaagcagatgaagttagtcttcaggaaaaagaaactctttgtaccgattctttactcaaccgagaaaaattaggcaattccagtttgggaaacggtatggctatgcctaaaggaagattacccctaggtaatacacctatcgcagtctttttacaactgagtgcacctttaaaatatgatgcacttgatcatcgtgaagtcgatcttatttttgccttattatccccgacagaacattgttccaatctcgttcaagaattgccccatttagtagagcgtttaaaagacaaatctctaattaaacaattaagaaacgcacaaagtgcggaggaaatttggcaaatttttcaattttcagatagacaggcggaaacattaccaactactgaataacaccatgctgaaacaaaatatcccgaggaagaataaaaatggagattatcattattagtggacgctcaggtgcaggaaaatccgtagcattgcgagcattggaagatattggctattattgtgttgataatctcacgatggatttagttcctcaacttgttgatatgttggaaaacaaacagcatttagtagcaatcagtttagatattcgtaacttacctcaagaacctgaaacattggatcacatcttaaatttgctgcaagaaaaatatccggtaaaaattattttcttggatacggatagaaataccctaattcgccgttatagcgactctcgtcgtttacacccgttatcggtccaaaatctgtctcttgaagcggcaattgctgcagaaaaagagcatcttgaacctttagtacaacatgccaatgtaattattgataccacaccgctttctccccatgaacttgctgaacgtttacgtgaatttttgcgtggcaatacggaaaaagaattacaaattattgtcgaatcttttggatttaaatatggtattcctttagatgctgattatgtttttgatgtgcgttttttaccaaatccacattggaatcaggaattacgcccaatgacaggattagaaaaaccggttatcgaatttatgcaaaaacatattgaagttgacaactttatttatcagacacgtaactatattgaaaactggttgccaatgttagaaaaaaataaccgcagttatttaaccattgcaattggttgcacaggcggtaaacatcgttctgtttatatcgctcaacaaattggtgaatatttccgagcgaagggaaagaaagtgcaaatccaacataaatcattggaaaaacatgcacaaaataaataaccccaaacttaaattcggggttattttgtcagtaattatttaactcgttgtcccgcttttgcacctgcatcaacatcaagtaaatataaatccgcaccaccgttgcctgcacttaaaatcataccttcagacattccaaacttcatttttcttggtgctaagtttgcgaccataatcacaaaacgcccctccaaatcttccggcttaccatacgccgctttaattccggaaaatacttgacgagtttcattgcctatatccagtataaatttcagcaacttattactttctggcacggcttcacatttcaaaactttcgctacccgtaaatccactttgcaaaaatcatcgatagtaatgttttcttcaattggctcaaactcggaaaatgctttattttctaccgcacttttccctgcggtttggttagctttcgcattttctatttttgaagcctcgatcatttcttcaatttttttcatatctaagcgtgaaaatagaggtttaaacggtgcaatttgatgatctaacaaagggcttgctacattttcccaagtcaattgcgtatttaaaaatgcttctgcacgtgctgctagatttggtaggacaggtttcaagtaacctattaatacacggaataattcaatccccattgaacacacttgttgtagttcatctgtgcgactttcgtctttggcaataacccaaggtgctttttcatcaacatatttattggctttatcagtaagtgccataatttcacgaatcgcttttccaaactcacgattttcatagtagtcggcaattaactctgactgtgcaataaattcatcgaacaacattttatcatctaatttatccgccaatttcccgtcaaaacgtttttgaataaaacttgcatttcttgaagctaaattaactaatttattcaccaaatccgtatttacacgctgtacaaaatcgtccaaatttaaatccaaatcatcgatacggctgcctaatttagcagcatagtaataacgtaagcattcaggatctaaatatttcaagtaagtggcggcttgaataaacgtccctcgagattttgacattttctcaccgttgacagtaacgtagccatgtacaaaaatattattcggtttgcgtaaactggctccatccaacatcgccggccaaaataaactgtggaaatacataatgtctttaccaataaaatgataaagctcggcatgactctctttgctccagaaactatcaaaatcaataccgctctttttgccacagagatttttaaacgatgccatataaccaatcggtgcatctaaccacacataaaaatatttattgtcagtattaggaattttaaagccaaaataaggtgcatcacgagaaatatcccattgttgtaatccagcctcaaaccattcctgcattttatttgcgacttcttgttgtaaagaccctgaacgtatccattctgtcaacattgactcaaaagcaggtaaatcaaagaaaaaatgttcactttcttttaataccggcgttgcacctgatactgttgaacgtggtgaaataagttctgtcggactataagttgcagaacaaacctcacagttatcgccatattgatcttccgccttacatttcgggcaagttcctttcacaaaacgatcaggcaaaaacatcgctttttcaggatcgaaaagctgagaaatagtacgagttttaataaaaccattttgctttaatttatgataaattgcttcaactaactctctattttcatcactgtgagtggaatgataattatcaaaactaatgttaaaaccactaaaatcagccatatgtttttgttgcacatctgcaattaattgctcaggttttacgcccatttgatctgctttaagcatgattggtgtaccatgagcatcatctgcacaaacaaaataaatttcattgccacgcattcgttggaagcgaacccaaatatccgcttgaatatgttctagcatatggcctaaatgaataggtccgtttgcatagggtaaggcacaagtaactaaaatttgacgtgaattcgttgacattaatttaacctttaaatatgaaaattttgttgttcatcttaccttattagtggtattttttccagctctcgatactttacaatcgtagttatgctatgatgaccgtagcaatttaacttgtttctttaggaaaaaagaatatgacaatccatttttcacataacctctctgaatcacaaaaacaacagttacaagaatgtttccgacaatttagtcatactactttacaaaaagatttaattagcttaggtgcggtcaaaaaaatcgaacttggcggcaatatgttacggatagagctagtgatgccttttgcgtggaacaccggttttgcacaattaaagaccgcacttagcgataaattagaagcaatcacacgagcaacagaaatcaaatggttacttagctatcaaattgccactctaaaacgagcaaataacctgcctgctgtaaaaggtattaaaaatattattgcggtaagttccggcaaaggcggggtaggaaaatcaacaatctccgtcaatcttgcactggcattacaaactcagggagcaaaagtaggtatcttagatgcagatatttacggaccttccataccgcatatgctaggcgttagtcagaaccgccctacttctccggataatcaacatatcgatccaattcaggcacatggcttagctgccagttccatcggttttttaatggagccggacagtgccacaatttggcgtggcccaatggcaagtagtgctttaagccagttattacaagaaacactttgggcaaatcatggtgaattggattatttggtgattgatatgcctcccggaaccggtgatattcaattaacgttatcacaaaaaattcctgttaccggtgctatcgtcgtaactactccacaagatattgcattacttgatgcaatcaaaggaatttcaatgttccaaagtgtacaagttcccgttcttggtattgttgaaaatatgtctgttcatatttgtagtcaatgtggtcatcatgaaacgattttcggaacaggcggggctaaaaaaatggcacaaaaatatcaaattaaactcttggctcaactaccgttacatattcaattacgtgaagatatggataacggtataccaactgtcatttctgctccagaaagcgaaatatcgcaatctttcttacaattagcagaaaaagtagcttctgaactttattggcaaggtgaaattattcccggagaaattttattcaaagaagtaaattaatatccaagaaatttctagcgtcgggtttgtcctctcttgttcgggctatgatagcatttctctctaattcagcaaggacgcttaatagttgagttaatgctatagaaagaggggtattccgtgctgttgtatcgaacattccgtctagtgttttaaagtcgatttttctatcgtgaaattcagttataacacctataacttgtaatgcaccctgacctatctaggctagcaacaacatcccccctctcggatataattcagtaattctagcctttctgcattattttccctagttccctgaattttgcagcctgcttttttaattggtttatttggtcttttaagtcctgcttatgagttgatactccagcaaatccaacaagagctatttttacctctattcaaaagttacataataaaaacaaatatattgattacttctattttgaagctgtttgcgagtaggtatttaaacgagaaaatttcaacgcatcaaattcatcgtgtataacgtattggtaaatcagcaccaaatccccttgaatatggcaatctcgataacctttccattctccaactaatgtgtgatcttgatagctttcaggcaatggcaagcggtttaacaagcagtgcattgctgtaatatatttcgttcctactagcacatttgggtaacgttttgccaaatcagtcaaatctctagcaaattgtttagagtaactgacctttaattgtttaccagacattagttacccgttaagaatgcgttttgtaaactcttcgacagaataattttctccagcttcaataaaaaagctctctgcattaccgctatctaattcgtccatagctgctaaggtttctttatttgggcgaagataattcaaatcaacagggatagagcgagtcttggcaatttgaaccaaaaacatattaaatacttgtgatggtgtaagaccatattgttcaatgacctgataggcttcggatttagtttgctcaactgttctaaagctgatagacgcatttgtaagtgccataagttttctccatagtattacattgaaagactattatagtaagaatgaagttaaaaatctacatttttaatgagattagggattttcatttttaattgctattcaaaagttttcaatgtatatttttgaatatagtcaaaaataaaaacggagcgttacgccccgtttaatttatttttcactttcttccaattcgtctgccatcgctgataaaatttctctagaaagcaaaactaaagcacgataaaagggtaaatttgcatgcttttctacttggttaaaaaactgactagcacaaggtaacaaaaaaatttcaaatagttctcgctgggcttgaatggaatttaaattatcttcaatccaagaggcagttaaaaaaaccaacgcaaaatgatccgcactttctaccactgggcatcctcgctcttgtctaaacgaagaaaattcatccggattaattccataatcagagattttcattgaaataagtggcgtatcagtcataaataaacgctgatattctatttccagtgcgtttaaatccattggtatttgcaaactatctaacgcctctttactttgtttatctgtttccaaacaccaaacctgttccaaacctttttgttgtaaccaagaaaatacgtctgtcattataggatctgtcggttgacgataaaataaattaccgaacaatcggcttattaaggaaaaattattcatttgagctacaatcacgcaataccttccttttgtaacgctaaaagagcggtgagatttttcactgttttttctcttacttcttgcaagatatgttgcttagcttgttcatctaaaatgtgaatatcaccgaaaaaactatgatcaatatcagtaactccacaataattaaacagaccatcaactaagcaattttgtaatgattgtgcaaatccacgttcttgatatttctgtaaattattacccatagtaataaattgttgtatttttttaccatgtaaaagcccctctgaaacaccattttccgttttgtaggcaaccccatggcttaaaatacgatctaaatagccttttaagattgcaggaaatcccatccaccacaatggataaataagtgtaataagatcagattgatcgattaattcttgttcataacgaatttctgccggtgtgattttttgttgtgctgcctgtaattcttcccaagataaaattggattgaaatcaagagcatacaaatccctaactcgtgtttcaacccccagtttttgacccgtctttacagtttgctctaatattgcttggttaaaactcgtctgattattaggatgagtaaaaataattaagtgtttcatttctttctcttattttttttgaacgatcaacgtaattccattcacagcttgaacttcaataatatccccttgttgcaaccctttaccttgaatacgccaagtggtatcgccaaaaacacctcgaccaatgccattttcggctatcacttcaaccttacctagacatcccaacatggcgtgatctcgccggtttaaagaagaatttgcctgatctttttcatctttagtatgttgatatttccaccatgcgacactcaacactattgctaagatgccataaataacgcactgtatagtcagagataaatcaataatgatggtgatcattgaaacaataatagcggctaaaccccaccataataaaaaaacgcctggaacaattatctctgcaatcaataataaaaaacctaaaatcagccaatgccaaaatgtccaagcgtcaaaccattccattttacatgtttcctctcaatagaggacgcctaagcgtccattgatattactgtttattgccttttaacaattcagcaatgcctgcaacagaaccaattaaatttccggcttcaagtggcataagtacaatcttactattatttgcactaccaatctcttttaatgcttcagtgtatttttgagcaataaagtaattgattgctttagtatctccacttgaaattgcgtctgacaccatttgtgttgctttcgcctcggcttcagcagcccgttcacgagcttcagcctgtaaaaacgcttcttgacgttcaccttcagcttttaaaattcgagactgtttttcaccctcggcacgtaaaatttcagcttgacgcacaccttcagcctctaaaatatcagcacgtttattacgttcagctttcatttgtgcattcatcgctgcaatcagctcttgcggtggacgaacatcacgaatctcaatacgtgttactttaattccccaaggattcgttgcttcatctacaatagctaataaacggctgttgatattatcacgttgagaaagcatttcgtctaattccatagaacctaataccgtacgaatatttgtcatggttaaattaatgatggcttgttcaaggtgattgacttcataagctgcacaacgagcatcaataacttgcacaaaacaaaccgcatcgatagacacattagcattatctttagaaataacttcttgcgatggaatatctaagacttgctccatcatattaatacgacgaccgacacgatccacgaaaggtacgacaaaattcaatcccggtgttaaagtgcggatataacgcccgaagcgttctattgtccaatgatagccttgaggaacggtttttaaagttgaatataaaataaatacaattaataaaataaaaataatcgtagcaattggtaacccatcaaatagttccatttcatactccttgcaaaataaaacaaacacaatataaaaatactaccagcatatagtagcttattttagtttatttatctaactaaagtgcggtctgaccaagaatataagatacttattttttagttaaattcgtgacaattttagttaattatttctttatttgacttttattaccacttaatccggtctgtttcattggtttgaccacaaccatcactacgtttttataaaaagcagtatacggtataatagtttatccatcataaaaaggtaaataccatgtctagatatgcaaaaattttattgttaaacggtcctaacttaaatatgttaggaaaacgtgagcctacacattatggcaatctctctttagaagatattgaacaacgcatgcaagaattagctcaacaacatcaacttgagctaagttgctttcaagcaaatagtgaagaaaaattaatagataaaattcaccaaagctttcatctaatcgattttattattatcaatcctgcggcttatactcataccagtgttgcattacgtgatgctttgctatcagtatctattccttttgtagaagttcacttatccaatatccatagacgagaaccttttcgtcaccactcttatcttagtgatattgccgaaggtgttatttgcggattaggtgctcaaggttatgaatttgcattacaatatgcctcgaactatctaaagaaaataaaataatttgcataaattttaccgaatttcacagaaatttatcgcaaaaatttattttttcaggtaatctctcgggcgaaataattcattttaaattaaccgcacttttttatcctcaattttgtctaaattggggattttaatggcgatttatttatgaacagtattaattttagttattttaggaaatcattatggacgttcgtaaaattaaaaaacttatcgaattagttgaagaatcaggcattatggagcttgaaatttctgaaggagaagagaccattcgcattaatcgtggctcccctgtttccaatcctattcaatataatgttcctgttacagcacctacaccagtagttgctccgcctacagtgtcggaagcaaccggtacgccagtaacacaagtaaatgaagaaccgtcaggtcatattattcgctcaccaatggtcggtactttctatcgtagcccaagcccagaagccaaagcttttattgaaataggacaacatgtcaaagttggtgatacactttgtattgtcgaggctatgaaaatgatgaataaaattgaagctgataaagcgggaatcatcaaagcaattttagtcaatgatggcgaacctgttgaatttgatgaatctctgattgtaatcgaataattattttacttttataggacttttaccgtcctacaacattattccaagagatagattcttatgttagaaaaagttgttattgccaatcgtggtgaaattgcattacgtattctgcgtgcttgtaaagagcttggtataaaaactgttgcagtacattcaacagccgatcgtgagttaaaacatgttttattggctgatgaaactgtttgtattggtcccgcaccttccgccaaaagctatttgaatattcctgctattattgcggctgctgaagttactggtacagatgcgattcaccccggctatggtttcttatccgaaaatgcggactttgctgaacaagttgaacgctcaggttttatttttatcggtccaacagcggatgttattcgtttaatgggtgataaagtttctgcaattaatgctatgaaaaaagccggtgttccttgtgtacccggatcagacggtcctttaggtgccgatattaataaaaataaagaaatcgccaagcgtatcggctatccaattattattaaagcctccggtggaggtggtggtcgtggaatgcgtgttgtacgtgatgaaaaatcattggaagaatctatcgctatgactaaagctgaagcgaaagcggcttttaataatgatatggtttacatggaaaaatatctggaaaatccacgtcatattgaaatccaagttttagcggatacacatggaaatgccatttacttagctgaacgtgattgctcgatgcaacgtcgccaccaaaaagttgttgaagaagctccggcaccgggtatttcagaagaaacaagacgtgatattggtactcgttgtgctaatgcctgtcttgaaattggctatcgtggtgccggtacatttgagttcttatacgaaaatggtgaattttacttcatcgaaatgaatactcgcattcaagtagaacatcctgtaaccgagatgattaccggtgttgacctagttaaagagcaacttcgaatcgcagcaggatttccgctttcaattaaacaagaagacataaaagttaaaggtcatgccatcgaatgccgtattaatgcagaagatcctaagacctttttaccatcccccggtaaagtaacacacttacattctccgggtggtttcggtattcgttgggattctcatgtttatggtggatatacagtgccaccacattatgattcgatgattgctaaattaattacttatggtgatactcgtgaagtagcgattcgtcgtatgcaaaatgcattatccgaaactattatcaatggtataaaaaccaatatacctttgcataatttaattctttccgatgaaaatttccaaaaaggtggaacaaacattcactatcttgagaaaaaattgggtatgagagattaatatcactctcattgagttataaaaataaaagcaaaagtggataatagtatccacttttttatggataaaaaatgaaagtacattacaaacaatcagctaaagaatctcgctatgccttgtgcttaacagtgctatatcttatcggctggtgcatttttgcctatttacctgatgaggcaagaggtccgcttggttttcctctttggtttgaattgtcttgcatatactttcccatagtgtttattatcatcgtgtatttgtgtattaagttcttttttaagaatctatcattaggagaggaaaaatgaacattaatatcattttacctttggttctctacttgctctttgtattcggcattgcttactattcctatcgtcaaagaagtcaaggcaatttcttaagcgaatattatattggtaaccgctctatgtcaggctttgtattagcgatgacgacagccgccacttatgttggagcaggatcttttataggcggaccgggtgccgcatataaattcggtttaggttgggtattgttagccatgatccaagttccggtagtcttgtttactttaggggtactgggtaaaaaattagccatgctggcacgaaaaaatcaaagtttaactgttaatgatattttattctctcgttataaaaatccctatattatcctactggcaagcctttcattgctgttttcgttctttataatgatgtccgtgcaatttatcggcataggtcgtttattagaaactacattacatatcgactaccacatttcagtactcatttttgctaccactgttggtatttacacttttataggaggctttagagcggtagtactgaccgatactatccaaggcctcatcatggttttgggaacctttttattactgggcggtgtcatttatgcaggaggcgggattagccaacttattgatcacttagctaaaattgatccgcacttaatcacgccttatggcactgatgacagaccgcttgattttacatttatggcttcgttttgggtattagtctgctttgggttactaggtttacctcatacagttgtgcgtgctattgcctataagaatagtaaggcattacatagcggtattattatcggtacaatcgtcatcgctgtactaatgctcggaatacatttagccggtgctttagggcgtgctgtaattccaaccttagatgtaagtgataaaattattcctactttgatgatacaagtattaccacctgtagttgctggtatttttcttgccgcaccaatggcggcaattatgtcatctgttgactctacattaatccaaatgtcctctactttgattaaagatctatatttacgtttttaccccgctcaaatacacaatgaaaccggaataaaacgcctatcaatattaacaactttatttctaaccttactcgttaccatagcaaccttaaatccgcctgatatgttgatctggttaaatttatttgctttaggtggactggaaaccacatttctatgggttatgttatttggcctatattggaaaaaagctaacgcttatggtgctattagttcaatgttagtcgggctaataagttacatattacttaccgctcttgacataaaattatttaatttccacgctattattcccgctttattatttggcttaattgcattcttattgggaaatcaagtaggaaataaattgattaaaaataaggaaaaataaatggcttgggtacaacttcgtttaaacagtacaaatgaaaaagcagaaaaaatcagtgaatatttagatcatctaggtgcggtgtccgttacgtttatggacagccaagacacaccgatttttgaaccgctaccgggggaaacccgtctgtggggaaataccgatgtgattgccttgtttgatgcaaaaaccaatatgcaacaaattgtccgcctattgcaacaaaaaaatcatcttgatgaaaatactgcttataaaatcgaacaaattgaagataaagattgggaaagagaatggatggataatttccatccaatgaaatttggaaaacgcctatggatttgtcctagctggcgtgaaatacctgacgaaaatgcgataaatgtcatgcttgatcccggtttggcttttggtacaggcacacatccgacgaccgcactttgtttagaatggttagacagcttagatttaacaggaaaaactgtgattgatttcggttgtggttcaggtattttagccattgctgcccttaaattaggtgcaaaaagtgcggtcggaattgacattgatccacaagctattctcgccagttataacaatgctgaacaaaatggtgtagcagagcgtttacaattatttttatcagaagaaaaaccaaccgatttacaagcagatgtggtgattgccaatattcttgccggtccgttgaaagagctttacccgataatcagcaatttagtcaaaccacaaggtgatttgggcttatccggtattctatctacacaagcagactccgtttgtgaagcctatcaagggaaatttactcttgatccgataactgaacgagaggaatggtgccgaattaccggaaaattaaactcatttgtctaattcatttatatgattttatacaaaaaataaaagtaaatgatataaaatttaaccaatatcaaaaaaatgtaatttgtataaaaaatattctttgcaaatgacttaaaagtgcgtatcataacgcaccttgtcgccttgactagcgaaagcaataaatctgatatagcataatttggagaagcagaagtgcaaattggttcttatcaattaaaaagtaatgtacttttagctcctatggcaggcataacagatcagccttttagaaggctttgttctttttatggagcaggtttgacttgctctgaaatgatgtcagccaatccacaagtttggcatacagaaaaatcaagattgcgtcttgcccatcatcaagatgcgggaattaacgctgtgcaaattgctggttccgatccggttgagatggctcaagccgcacaagtgaatgtagaatatggtgcacagattattgacattaatatggggtgcccagctaaaaaagtgaaccgtaaattagcaggatctgctcttttacaatatcctgacttagttaaaaaaattctatattcggtagtcaaagcggtaaatgtaccggtaacattgaagattagaacaggctggaatcaagagcatcgtaattgtatcgacattgcaaaaattgctgaacaagcaggaattcaagcattaagcatacatggacgtacacgtgaatgtttatttaatggaaatgctgaatatgacagcattaaaaaagttaaagaacaaatttcgattcctgttattgctaatggtgatataacaaccgcaaaacaagcacaagaagttctcagttatacgggaacagatggaataatgattggacgtggggcattaggtaaaccttggctatttcagtcaatagtaagcttaatcgaaacaggtatcactattccagagccaagtttagatgaaaagtgcagcgtgattttgcaacatattcgtgatctgcatcagttttatggtgaagataaaggatatcgcatagctcgtaagcacgtatcttggtatttagagggaattcaacctaattccgattttagacagacttttaatgcaattacgaatgctaaagcacaactaattgcactagaagatttttttaattttattttattggataaagaaacatgttagaacaacgtaatccggctgaagcattaactgtttcagtattaaattcacaatctcaagtaacaaataaaccacttcgtgattcagttaaacaagcattaagaaactatttatcacaattagacggtcaagatgtgaacgatctttatgaattagttttagcagaggttgaacaccctatgttagatatgatcatgcaatatacacgtggtaaccaaacacgtgcggcaacaatgctgggcattaaccgtggcactttacgtaaaaaattaaaaaaatatggtatgggttaatttcccttgctgaaaaaataaggtcgctaatttggcgaccttttttaattactctatttcaatttttttaataaattccgaactcaaatctaacaaaggtaaatccgagccttgccaagaacgtaaaatttgataatccattaaacttaatgtatccaaccccggagtaacatttggcgtatattgttttgcgatacgagctaattgggtcaatcctaaactgctttcaatagacgagctgatcactgcttttaagcccaattgatgtgctttttcgattaatttaacacagtcttgcaacgaaccaatcaaagtaggcttaattacaattgctgctaagtgcggttctttttctaatttaaatccttgttctcgaatactttcgtcccaagctaacgctatacccgtatcctgtgcaaattgacgactatcgtcttgcgttttacaaggctcttctaagaactgaatacgcttgcgatgttcaggctttacatatttggcaaacaactgtgctttcgacaacgtccaactacgattagcatcaagacgcaaataaagatcaggaattgcttctaacaacatatcagcaatcataccatcacgatttgcttcatacatgccaaccttaattttagctaccttctcccccggaatttgatttaatacatcataaagctcatcaggatcgccgtaacataacggggcgacttgatagtttccttcttgcaccaattctccttccatttcagccaaagcacaacttaagccaaaagcaacagacggatatagcccttgcaatgaaaatttttgatttgcagatcttgcctgcacccacttttttaaccattgaacagtttgctctttcgcctgttctagagtttcttggctaaattcaggcaaaggggcaatttccccccaaccttcatgctcaccacattttatttgcacaaacaacccttcacgtttcttcaaaaagcgattgcgcaaaataagctggctatccacaggaatagcatattggtataaatgaaaaattcgatttgtcattactgttcacattgttgtgtattgtcattataacgaccaccataatctaaacagtgatcttttgcatcaaaaataacgaaagtggcaaaaatacctagcaccactaaaatcactaaaagaaacaaccattttttcaacattattttttcctcaaacaagacaaaagtgcggtcaaattttccactattcttaccgcacttttactgattaaatttatggatttcgcttaaatttactgaagtcaggtgcacgtttttcattaaacgcattgcgtccttcctgcccttcttccgtcatataaaataacatagttgcattacctgccagctcctgtaaacctgcttgaccatcacagtccgcattcaaagctgctttcaaacaacgcaaggcaatcgggctgttgcgtaacatttcacgacaccaacgcaccgtttctttttctaaatcagcgtaaggtacaactgtattgaccaatcccatttccaatgcttcttgggcattatattgacgacataaaaaccaaatttcacgtgcttttttctgtccaacgatacgagccatatagcttgccccccaaccaccatcgaatgagccgactttgggacctgtttgcccaaaaatcgcattttccgctgcaatagttaagtcgcataacatgtgtaaaacatgtccacctccaatcgcataaccggctaccattgccaccacaggttttggacaactgcgaatatcacgttggaaatccaacacatttaaatgatgcacaccgctttcatctttatagccaccgtaatcaccccgcactttttggtctcctccggaacagaaagctttttccccttgaccggtaagtataattacaccaattttttcatcaaaacgtgcatcggaaaaggctcgaatcatctctttaactgtttgtgggcgaaaggcattacgaacctcagggcgattaatagtaatttttgcgataccgtcagtagatttatgatacaaaatatctgtataacctgaactgaaatcctgccattcaacaggcacataaagcacatcatcgtttggattttgcattatttattccttttttattaagtcaatttgtggttggtattataacttaaatgccaataaaaagtgcagtcgttttagtggaatttttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttattctacataattaaaaaaacgccacagttctatccgtggcgtttccaaatttgagcaaaataaattatgcttgacccttaaccgcttttaaacctaaaaacggtgctttctcacctaatgcttcttcaatgcgaattaattggttatattttgcaatacgatcagaacggctcatagaaccggttttaatttgaccggctgctgtaccgactgccaaatctgcaattgttgcatcttcagtttcaccggaacgatgtgaaataactgcagtataacctgcatctttagccattttaatggcggctaacgtttcagttaatgaaccgatttggttaaatttgatcaagattgaatttgcaatccctttttcgataccttcttttaagatcttcgtattggttacaaatagatcgtctcccactaattgaactttatcgcctaatactttggtttgatatgcaaaaccgtcccaatcagattcatcttgaccatcttcaatagacacgattggatattctttgcataacccttctaagtagtgagtaaattcttgagaagtgaaagatttaccttcgcctttcatttcatacataccgttttctttgttatagaattcggaagaagcacagtccattgccaatgttacgtctttacctaatacataacctgctttttctaccgcttctttaatgcaagcaagtgcggcggcgttagactcaagattaggtgcgaaaccgccctcatcacctactgcggtgcttaatccttttccttttaacactttcgcaagattatggaacacttcagccccaatacgtaaagcttcttttaatgttttcgcaccgaccggttgaatcataaattcttgaatatccacattgttgtcagcatgttcaccaccgttgatgatattcatcatcggcaacggcatagaatatacacccggtgtaccgttcaactctgcaatccaagcataaagaggcatacctttagaggcagctgccgctttagcatttgctaaagaaaccgctaaaatagcatttgctccaaattttgatttattttccgtaccgtccaattcaatcatgatttggtcgatttcagcttggttgcttgcctcttttccaactagtgcggtagcaatttcgttatttactgctgaaacagcttttaatacacctttacctaagaaacgagctttgtccccatcacgcaattctaatgcttcacgtgagcctgttgacgctcctgatggcgccgctgccaatccaacgaaaccaccctcaagatgaacttcagcttcaacagttggattgccacgagagtcgatgatttcacgaccaattactttaacgatttttgccattttgttttccttctatagttaatctaaaataagtataaaaactggcgatatagtaaagctatttcgtatgtttgtcttgtaaaaaagcactttttttgattttaatccatataaattgaaagaaaaaatactcttacatatttatttttgtaattttataaaattacaattatttatattgccagtatggagaatatttattaaaattctgctatgtcatttaaataaggtatagttttatgttgttaagtaatattgtggagatcagtagcggacaggcacagtttcgtctttccgaagtcagtgatccaattgcacctgtttatacttattatggtcaggcaaacttagaacaagatctctatttatctgatggttcagcagtacttcctaaagaaataaaaacttttgataaaataaccagtttactttccactggtgatgtgatttttagtctgatttcaggtaaggcaacgattgtcagcaaacaacaccaaggttttttatatactcaaaattacgttaagttaatacctaaaaatcagatagatgccaattatttagtctatttattaaacgaaaatgcggtggttaaaaagcagttaagtcgtggtttgcaaggatctcaagtattgaaatatacgactaatcagttgaaatcattgagattacccaaattaccccacttatcggaacaacgtttaatgggagagatttacctaaaacaacaaaaattagcttatctcaaacaacgcatagcgaatttagaaaaattacttgtgttacaccaattgcaaaagcgagtacagcatgactaagaaaatacccgaattaaaatttgaaaaaaccttaattgaatatctttgtacaggaacgattacagcaacggataatatgatcggcgaaccgcctgcggattatgtagtgcgtaccaaattgtggcaatatgagccaagcattaaaacgacggaagatttatgggaaaattttaaaagaattttagaaaagctcaatcaaaaaaccttagatcgtcctttaagtgcggtggaatttgcacaagttaaacgtactatttctaatttatccacgccttatgccgcagggcagtttctttatggcacaaacggtgtgtcacaaattgaaattgatttagatgatgatcgtcatgtgtttttaaccgtatttgaccaaaaacaaatcggagcgggcgatacggtgtaccaaattgtgaatcaaattaaacgaccggcgattattgcaggaaaagaaaatcgacaatttgatactacgttgttgattaatggcttgcccattattcaaattgaagaaaagaaagaaacgcatgatattaacgaagccttaaatcaaatgcaccaatatatcgcggaaaatcaatacagcgatattttttctacgttacaacttctgattgcgattacgccaaacaatgtgaaatatatggcgaataccacagcagatcgctttaataaagattttgccttcaactggcaacgtcaatcggacaataaaccggtttatcactggaaagcctttgccgattccatgttgagtattcccatggcacatcaaatggcgactaactatatgattttagatggtacgccgaataagcaaaccctaaaagtaatgcgaccttatcaagtttatgctacgcgttgtgtgatggataaactcaaacgggcggatttcgatcaagcgttgaataaactcggttatatttggcataccacaggttcaggcaaaactattacgagctttaaaaccgcttggctggcaagtcgttcgccgaaagtggataaagtggtttttttagtggatcgtattgcactgactaaccaaactaccgaaaactatcgagcttatgatcctgatgccacggaagatagcctaggtagtgtactggataccaacaacaccacagatttgaaccgcaaattacacagcaaaggcagccaaattattattacctctgtgcaaaaactggataccttggttaaacgcacttctttcaaagctcccgaaaaaaacattgtgtttattgtggacgaagctcatcgttctacaggcagtgataattttgctgcgattcaaaaaaaatttaaacattctgcgtggattggttacaccggcacgccaatgtttgatgacactaccaaaggcttacgaactgaagatattttcggtgaactcttgcacgcctataccattcgagaagcaattgctgatcgtaatgtgttgggttttaaagtggattttgaaaccacgattagcgaaaaaagtatgaaagaagcgcatctaccgaaattctatcgccttaaatatcctcattggacggaagaacaaattgccttgaagattgccaatctcacgcaacaagatatggacgacagcatcgaaccgagtttttatgacgaaaatgaagaacacgtcagattagtggtggaagatattttcaaacattggaaaaatcgctccaattgggataacaaacgtaatcgtggacgatataacgccttgctgaccacgcacgtgggtggcggcaaagccagtacaccaatggcaatgatgtatttccgtgaattccaacgtatcaataaagtgcggtcagaaaagggggagtttttgctaaaagttgctgtgacctttagccaaaataccagcaataacgacaccatgcttgaaaccaaccaaggattattcgaggcaattcaacattacaacagcgaatttggcactaacttcactatgtctgatgtatcggcttatactcaagatgtcaccagccgtttaaatcgcaccgctgtggacaaacaatatttagacctcgtgattgtcgtagatcagttactaacaggatttgacgcccctgaattaaatacgctttatgttgaccgcactttaaaaggtgcaggactcattcaagcctattctagaaccaatcgtgtagcggatatgcgtgaaaaaccttgggggcgaattatcaattaccgctggcctgcccataatgaaaagttaatgaatgaggcgttgtccgtttacgccaacaaagattccgccaaattatccgatgaagagcgaaaagtgaataataccaaggataagattactgcaccaaaatacgaagaattgctcgatgacaccaaacagattgtggaaaatctgcgagaaataacggataactttagccaattgccaccgtctgaagcgaaaaaatgggaaatgttggaacaattacgcacctataccgccaatattgccaaaatcaagcaatattctgcggaagatgaaaatggtgaaattatcggttttgattatgaaaatccggataaattgattcaagaactcggcatgaccagtgaagaagaaagtatgctcaccaacacattgtccaacgaactcaaactgcatttagcaaaaagccgaaatgtgccagtgatacaaattgagctacaaatgacccacattaaagacgtggaaattaattacgattacttaactgaattaatttccagcttgttggcacaagtagaggcaggtgaaacggaaaaagccaaagaaacggaaaaagaattggaaaaatttgccaacggcttggaagatcgcagttttgcacaacgcattaaccgtgcggcaaaagcgattatgaaaggtgtgttcaaattaaaagatgggtttaaaaaagacggtatttctattgtggaacaagcgaataacgccaaccaagatcaacaatttttggattttcgtctccaatggggattaacggaggtgattaccaacgcccaacttcgacagcttttttccaaacatcaatttcaacaaaaagatttagatgacaataatcagcttacggatttaatcaaacaagcaggtctcacttatctcgaacttgcacaaaatgatgaagtaaaaaaactgacaaaaatgaaataccgtaaccagttgcgtcatgctatttacgaacttgcagatgagtttgtgggggaataaataatatggaaagaaaaatcaaatcttggaaagattatgatgacttacttaagttattgagcattcgaaaaatggatgttgaaaatcaacaacgtacattacattatttaaaaaatataggatattaccgattaagtggatactggtatccatttaagcaaaaagatgagcaaaattcccaaaaagaacaaaaaactatattactagatgagtttaaaacaggaacttgcttttcagatattttagccctttatatttttgataaacagttacgttttttagcgttagatgcactagaacgtattgaaatggcagttaaaaatgatgtggtacatttattgggtaaattacatccactggcacatattgagccttatcaaatagatcaggatacaggaaaaaaagtttgttatttacatcctaattttattgcaaaaggggataaatattccaaatggaaagataagcataatcagcttattaaacgagctaggaaccgagatgctattaagcattacaatgaacaatatgccggcgtattgcctatttgggtttctgcggaagtttgggattttggcttgttatcccagttattttcagggttacggtataacgataaaaatacgattgccgcaaaatatggcgttaaagacggaaaaacatttgaacaatggctaaaaagtttaaactttattcgtaatgtttgtgctcaccatagtcgtttgtggaatttaaatatcattaatacatcggcaccactagaagaactgagttcaataaatcaatatcgtatcttcatgtacttgtgtatgatgcaaaagttattgacaataattaaccctaaatccacttggaatgagcggttatatcaattactaaacacattccctgaacctaaaaataaggcggtttcagtgcatgacataggattaccaaaagactgggaagaattagaaatttggaaaaatattaaagacaagaaatgagaactgacgcgtgcaaaagcagaggcgtcagtcatattggtgctgatagtatcacatcttatattttttgcaaaggatagaaaaacaaaatgaacaatgaaaaaagacttgtaccgaaattacgattccccgaatttactcacgcttgggaacagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagaacaacaaaaaatcggtacatttttcaccgcacttgatcgctacatcaccattcatcagcgtaagttggaaaatatacaaaaattgaaaaaatcattgttgcaaaaaatgtttccgaaaaatgatcaagaatttccggagattcgttttcccgaatttacttacgcttgggaacagaggaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaagaacaacaaaaaatcggtacatttttcaccgcacttgatcgctacatcaccattcatcagcgtaagttggaaaatatgcaaaaattgaaaaaatcattgttgcaacagatgtttgtttaataaggggcaaagatgagctattccattgaatatacacaagaaattgatcggttaagcaaagaaaatgcctatcgactttatgattcaggcgatattcatcgcttagaagtcgggacgacgaaaggcttgcaagatattcatcgttatttatttcaagggctttatgattttgcaggcgaaattcgtgaattaaatatttctaaagggcactttcgttttgccaacgcactttatttaaaaccagcgttaagtgcggtggaaaaaatgcctgaatcaacctttgagcaaattattgaaaaatatattgaaatgaatattatccatccctttttagaaggaaatggtcgttctacacgtatttggttggatttgatttttaagaaaaacctaaaaaaagtggtgaattggcagaaagtggataaaaagttgtatttacaagcgatggagcgtagccccgtgaacgatttggaaattcgctttttattacaaaatgcgttaacggatcgcattgacgatcgtgagattttcttgaaagggattgaacaatcttattattacgaacaagccgaataaactgatttaaagtgcggtcataaatacagaattttttaataaaggaattaaatatgagcaatgtacaaacaattaccggtaaactttgggcaatggcaaatgagctgcgtggcacgatggacgcttcagaatataaaaactatattcttgcctttatgttttatcgttatttatccaaacaccaagaactatatttggtcgataatcatattttggacatagagccttcgcaaagtgtgaatgacgcttatttaacgcaagccacaggtgaggaattacaagattatttgcaagatatttcagccagtcttggttatgctattaatcccgaagatacttgggattcattaatgcggaaaatttacaatgccgaagtgatgccaagtgattatcaagccttatttgataacttcaaccaaaacgccaatttaaatgaagatgcggtgctagatttccgtggtgtgtttaatgatttgaacttaggagcttctcatttgggcaattctaccaatgagcgtgcgaaatctttaggcaatattgtgaaattggtggacgagattgaatacaaagatgatgacggtcgggatattcttggtgaaatttatgaatatttgatcgggcaatttgccgccaatgcaggcaaaaaaggcggggaattttatacaccgcaccaagtttcaaaaattttagcgaaattagtaacgctggatgtggctgataatcaagagactttccttgtttacgacccaacaatgggatcgggttcgttattattgacggtaggtaatgaattgccacaatcgaaacccattaaatattatgggcaagagctgaacactacaacgtataacttggcacgcatgaatttgatgatgcatggcgtatcctataaaaatatgacgctatccaatgctgataccttagaaagtgactggcctgaaggtcttgatgcacaagggattgaccaacctttatgtcgttttgatgctgtggtggcaaatccgccgtattccgccaagtgggacaatcacgagcgtaaattaaaagatgcccgttttcaaccttttggtgcgttggcacctgcttcaaaagccgattatgcctttattttgcatagtctatatcacttaggcgagcatggcacgatggcgattgtattgccgcatggtgtacttttccgtggtgcggcagaaggtaaaatccgtaaggcattgattggcgataacaccagcaatgcacaaggaaactatttagacgcagtgattggtttgccagcgaatttattctacggcacaagtatcccaaccacgattttggtttttaaaaagaatcgtaaaaataaagatattttgtttattgatgccagccaagattttgacaagggcaaaaatcaaaaccgcttaacagacgagcatgtccaaaaaattattgacacttaccaagctcgtcaaaatgtggataaatacgcttatgtcgctcctcttgaagaaattattgagaatgactataacctcaatattcctcgctatgtggatacttttgaagcagaggaggaaatcaatattaacgaagtgttaaaacaacttcagcaagataatcaagaaatcgcacaattagaaaaagaaatcaacgaacagttaaaattattgggagttgaacttccataacaaggaaagagataaaagaggcaaaagcctctttttttataaaattttgcataatgttaccgcacttttgagaaaaaaacttacgcttgggaacagaggaagttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagaacaacaaaaaatcagtacatttttcaccgcacttgatcgctacatcaccattcatcagcgtaagtaatacatacaaaggagatatattatgaatgaagtaaattcaaacaaagagctgttttatcaatactattcacgctggatttatatgtacaaagagggggctattagaaaggtcactatggcaaaatatctaatgacattagagtggctaaaaaaattgattccaaatctcttattgcgtgatcttaatcgcataagttatcaacaattactcaatgattatgcctgttatcacgaaaggcagaccacgatggattttcatcatcaactgaaaggtgcaattcttgatgcggtagatgaagggttattaccaagagatcccacaagaaaagcaattatcaaaggtcgcccacctcgtttgaaaaaaacaaaatacttaaatcaatttgaactgcatacgttaattacacaattaaatttaaccaaagaaattaactgggattggtttattttattaattgctaaaacagggatgcggttttcagaggctttggcattaacaccaaaagattttgatttttcacatcaaacactgacaattaataaaacttggaattataaagatggtggtggttttcagcctacgaaaaatcgttcatcagtacgaaaaattcctttggattggcaaactattattcaatttgctgagttaattaaaaataagcctgaagaacagcctatttttgttcgtaaaaaaatttttaattccacagtgaatgatatcctgattaggcgttgtaaaaaagcaaatatcccaattatttcactacatggtttgcgacacactcatgcgtcattgttgctattcgccggggtatctattgcaagtgttgcaaggcgtttaggacattcaaatatgacgaccacgcaaaaaacatatttgcacattattcaagaattggaaaatcgagatattgatattgtaatgcgttctttatcaaatttaagttaatttagagctacgtcacttacgctgatgaatggtgatgtagcgatcaagtgcggtaaaaaatgtaccgattttttgttgttcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcccccaacttcctctgttcccaagcgtaagtttacataaaacaaaaaggctatcaaatgattgtatgatagccttaatgagataacttaaatttttctattttatactataattattttctctgattttccttagtcgcttttacaccacgatagtcaaagctactgggaattaaaatacctatgcctttcgtttcgacatcttgcgaatcaatgtatttaatattaacttcacctattggatttgcttcttgataaaacactttttccccattcagataaatccgcttcttgacaatcaagaaaaaattgatataaggcactctatttttgttcatgaaaaaaggatattatgtcaaaactttattatcggcccgaaattgatggactacgtgctgttgctgttttatccgtcatattatttcatctaaatccaacttggttaccaggcggttttttaggcgttgatattttctttgttatttccggctatttaattacttcaattattagccaagagatccaaaataatactttttcctacaaagatttttataatcgccgtattaaaagaatttaccccgtttttattttagtactggctattgcttctgtgcttgcttcgttattttttgttcattatgaatattcgcaattccgaagaattatcaactcagcagcactatttgtgtctaatttttatttagctcatcgacaaggttattttgacttatctgccaatgaaaatcccattttacatatttggtcattagcagttgaagagcaatattatttatttttccctcttttattggttgttgcctataaaaaatttaaaactcatcaagtatttaaacctatagtattaggtttaaccttactttttattttaacgtcatttatccctcaatcaatttatatcaaaatcggttggagtaatacttattacatttctttcatacgttttccggagcttttaatcggatcttatcttgcattaagtaaaccaagagtaaagcctgttaataattttgttggtttcggtatttttattgcatttatcttaacgctattcttttaccataaatcaatgccgttaatgccaggcattgttctactcctaccttgtattttaaccgcacttcttattcatttctcctcccaaaactcatggggggggggggtaaaaactctcttatcattaaagcccatcgtatgggtaggtaagttatcttattctctctatctgtttcattggatttttattgcttttacgtattatatttcaggtgaaaaggaacttcctcgaggtgcaattttaccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngattttttgcataaaatctcaacccaaatcagcaaaaaccacgcaatgatctatgttgaagatttgcaagttgcgaatatgtccaaatcggcaaaaggaacggtcgaagaacacggcaaaaacgtgaagcagaaatcaggtttaaaccgtgcgatactagatcaatcttggtttgagttcagacgacaactgggctataaaacgcaatggcttggcggatttttagttgccgtaccagcacagaataccagtcgtgcttgcccttgttgcaaccataccgcaaaagaaaatcgccaaacacaggcaaattttgaatgtgtagaatgtggctatacagaaaatgccgatgtagtaggagcaatgaatgttctcacacgtgggcaagcaatagtccaagcataataaatatcagggtaggacatacccgaagcgtctatgaagtgaatctcaatagagatcagcagtagaaacccgccgagagtagcccacagcttgctgtgggagctagtaggaatcccctgcctttaggcgggggaggatgtcaatatttccacgcacttgaacaaagcaagtgccagccgtgagaagctgaaaaatacaaaggcgaatagcacgcctcaagcgtgtttttttattcgtaatttacgcacacctaaaataaatctagcaatagatctattctcaatggtagagcgtaaagggcaaccgcttgcggttggctatgttcctttgtacgtagtttctcacccctttacgctttaccgcccgaccgtgagaagtctagcggaaagccttttaaacattacaaaggacaccgcaaaaatgctttataaattcattttattaggagaaaaccgcctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccgcacttttaagccttgtagcgattggagatgatagcaaaaacgatagaagaaccctaacaaaaaagccctcaaccaaatggcaagggcacaagtaaattaacttaactcataggaagaaataaatatggagttctaaaaagaacgtcatggattatagcctaaatgagtttgaaaaggtacagaaacatgacaaaaatcaaattttcagtattgctaaaaaatcaaagtgcggttagtattggcgacactactacaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactaaacaattgagaacaatcaaaatgctattcaaatttatcctattcttaggcgaaaaccgtctaaaactggctatacgtgctaattcagaacaacaggcacgcaatttattaaaccttcaatctaacgctttatttatcgcacgcattaacgacaaagggggtatttatgcttaatgagatagaacaaaatcaccgttacggcgtaatcctaacctatgaagacgggagaacgtttgaatgtgctgagggcgtaaccctggcaagagccttagagattaaagctaatgctaaaaaacaaattcaagcaaaagagttagctttttttgatgtattgacatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggtaaagaaacctatattttcaaggttttcaaaaaggaaaatttataaacaatataccttgtagaatatctctggtatctaacaaactataaaaataaaacttttataatagctaacaatataggtataacaaaccaaattctataatataaaaaacggataaatctttttattattgattcagtttgttcttgatatataagttcacttgcatatatatcagataaatttttatatatttcaccattatctcccatgactatactttcatcattaaatgattcagcaatttccattaagacttttaatgaaatttcatcaggattagagagccataagctattatcatcataagatataaaaaattcatacttatttttataaaaaattcttttttcataatctacggagaatcctaaactcgtcatcttgtttataacccgctcaaaatcatataatattttatcagtgctaagtttatctgacttatttacaatagatacatgatagcccatattatttttcctgcttatctgtaactgttttataaagttctatctaacaaatcgggttattaccacattcctcaagcatagctttacggttagattcgcttatgcctttatatttctcaaaaatcgctttcggctctttaccttctttctcagcttgagccagttctctaatatcacaatagtattatatttattttgccattctttatttgtttcaatttttcatttcttgctttgtatatatttattattttataaacatatgatccgatatttttttcagacatcaaaaaatctttccatataatagttttaccatcaaaaatatctatataatcccaaagggcatccaagttatttccaaaatattctcctaattctggaacttgcttggataattgcttataaaaatcatctggagaaaaaatttcctttccttcaattattatttccatcttccaacctctttaaatgttttataatgatctgtagtaataaataataaaccgtcacttgaatataataatctcgttcctagttgtttatttctacctatattgttattaataccaatatcagcctcataccaaactcttccatctttactaggtaataagttactttcgtttctaaaaatatccccaccaatttgcccttgttttaaaggtttgccacttgaccaattatataatttttagctatatccttagttacatactcatcaggtaattttccggtttttttcaaactatcaatgactagagctgtattttgttctgcttgtaaatctaattttaatttaggatacaacgctacattctcagccccgcttgatacccttagcttagcatcctgcttctcgtaaccttttggtggtgtaacaataggctgtctagtcagatatccttttatttcccttaaagataaagaaccaccacctacagccgccccagcttcaatagccatgctggcataatgaacactacttggcaaggctgcatagctgtttgtattctcatctcctacaaaggtcgccattttacctttaaggctattacttaatccatttacataagatatcactctcaacgcagaaaggtttttataaacttcatcattccctgttcccatttgataaatatggggaagataacaaatcgggttattaccacattcctcaagcatagctttacggttagattcgcttatgcttttatatttctcaaaaatcgctttcggctctttaccttctttctcagcttgagccagttctctaatcagcttttctacctcatagttattgagatagttattctccaccgcactttcctcaatctctccactcaatgctgcattttgtacggtgttcaccgtgctatttgattgattgttttatcgggattgtaagaaaaaatatccaaatctatattttcatctgtaaatatcttagagattatatatttaaatctctcatatctgtcatagatgtcagaattatctttagttaaaagggtaaaactatcccaatttggaattatcaataattcaattattcgcataatcccaattaaaatatcttgttttatcaattttgtgtttttataggttattgctatatttatcaaatctttttctagtttccaatactcatcatcattccattctgagtaatccaaccatcttcctataaatgaattttcatcatatagccttgaataggttacatttctataaaaatctgcgtattctgccatatttaatctccaattttatttaagttaatatcaaaagttccgtttcttgtttcttttttatttaatttttcaggactagctgcttctttccaagctcctccattatgaccatccacatctctagttatatagctattaccttttttaaacacaactgcaccagacttatcatcaaattttgttcactgactttttaaagtttgacgttttccttggttgtcaattgttttcaactctaatcccatcagctaattctaggtctaattccatatctatgatcaaatttataataattttttttgcatcattcgtaattgaaatttctctctcatataactgagtacagatcaactcaagagctataccatactcatcataattaattaaatccattgcattctcacaatcctcttcaggcaaatttttataaagcaaagatagtagatttttcattttttctttcattatattactcctgtttaatagggaatgcggtaattacaccatttcccattggttctacaataaccctaattctaacgccatcaacaactccctcaactttaaatctactcggaaccccctttttagtatacaaacttccttttgttcctgtttgttgtacccattctaaattaggatcagtagcaatattagatataacgtcgagaatttttttctcagaccagtgtattgggaatttagattttccattcagaatatttgtaaaagaaaatttatgcccaccacctgttttatctccatataatatatgttcagctctctgagaactgactagagataccatattttctctagcagttattagattagagacatttttagtaacaactttttgaaatacatttatagcttcacccgtcaataaaatactcggtgcttccaacgatttacccagactaagcatatagccttgcatttctgcggctaacatagagtcgttttctaaagcccaatttaactgctcattccattgttccgctgaaatcaccactttatcaaaggtctctttcgggttttggattacattcgccagtgttgcaacggttttatcaagatttactatcccatcaactgtgccttgtacaccttctacaaccgctttagcttccccaattttcattgcatcataataagcttccgctaattcctccgcattttctttatctttgaaaagcgttttggcaaacatttctatcgattgcttacgttcttctgatgggtgaatgtcatcaccaagaaaattaaactccaccgcattctcagccaccctcattcccgtactcactgtcgccaatgtaccggctgcggtatcactgcctgcagctacaccacctgccacacctgcaatccctttgataacctgaataagttcttgcttttccatttccgtcagttctgttggggatttgccatagacggtttcgcttaagattttcgcacccacttcacccacgcctgtagccactgcacctgccgtcgcactaccacctgataaccgggcttccattgctccccataaaatatgggcaggaatatttaaggcttgtaactcagggctgtctgtcactttcttaatcgcttcattcacataaggcgataccacacctgccacaattgcttctgtcggtttccctgcaacaataaggcttaataccgcagcgactgcggttgccgcctgtttcttgttaccacccgtttgccattcttttgcagcttgttggtaagcggtagcttcttgggctttttgggttgcagtaacaaggtcgccttctttagccgctttcgctgcttcttgctctgcttgtttcgctttttcctccagttccgctgcttgccgaccggcataggtcatcaccgcacctgcaacattgcctgcctcttgtgaaaggatttgttgttctttcaacaccttattaatgtctttcggtgcttcaacctgtttattcgccttatcaagttcggtattaatccccaacgcttttgctgtggtttggattgggtttgtgtctttgtttaaggtgattttcccttccgtaagcgtcgctttggtgattgagctgtcattactttgactatgcatcggtaagctcggggttatgttcggagcggtttttccttcaaccaacatcgcattttctgctcctttaccgtaagtgcctgagattgaaacacttgttgccttatgacttgattcattttgaatgtcattaaaagtgaggcgattggttcgcagttcactgttgtttggggtagttgaagcaatggtgctgcctttcaagtggacgttgtttgcctctatatgataaccgcctttgcctgcaattaaacctgcctgttcattaacttgtttataactgcttttacctttctcacccgaagcaaaaccgctcacactccaagcattaccaaaactcacatctacactaatccctgcctgactgcctttgctgttgtaattgttgctgtcttgcttgctttcaatccgaaggtcgcctttagcattcacatcaattcgctcagcagtagcggttgtgccgttgagggtaatgctcccttgactgttaaacttaatatgttctgcatctaaatgactgttatggtaagtggaactttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctgatgtataaacctcattaatatcggaattaccttctatataaatattaaaaatgccatttatccaaaaacaatcatcattccattcattaataatatcgcattgaattgcaaatttataaggatctccaaaaaacataattactcctatttaaattttagatcttcaggtattggtagaggattttttgaatcgcctgaactaccagaccaatgatactctccgttagtaccaaaaaatttgtgaacattaccttgagaatctttcgcatatcgaatcactttatttgattcaatcttatattctactgaatttttaaataactccaatgagtctctaggttcaattcctgcatctggtctatttcctggcataccctttgtatgttttgaattagatttatatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtccctatcgcccccgcactttgatttgctaatacaccggttaaaacagtggtcaataccttggctgttcggttatatgtgccattgttatcccattgtttttgggattgtgtcgctttaataagtgcggtcagttttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactgccgaactaatatgccccactgcccgagcaatctccttttgctccacaagcagttttttcacctctttcggttttgccacttggctgtttgcttggctaaggtcggtgctaatagccaacgcttttgctgtggtttggattggatttgtgtctttgtttaaggtgattttcccttccgtaagcgtcgctttggtgattgagctgtcattactttgactatgcatcggtaagctcggggttatgttcggagcggtttttccttcaaccaacatcgcattttctgctccttttttgctcagtttgccggtttcactatcttggtagtaatctgctcctttaccgtaagtgcctgagattgaaacacttgttgccttatgacttgattcattttgaatgtcattaaaagtgaggcgattggttcgcagttcactgttgtttggggtagttgaagcaatggtactgcctttcaagtggacgttgtttgcctctatatgataaccgcctttgcctgcaattaaacctgcctgttcattaacttgtttataactgcttttgcctttctcacctgaagcaaaaccgctcacactccaagcattaccaaaactcacatctacactaatccctgcctgactacctttgctgttgtaattgttgatgtcttgcttgctttcaatccgaaggtcgcctttagcattcacatcaattcgctcagcagtagcggttgtgctgttgagggtaatatccccttggctgttaaacttaatatgttctgcatctaaatggctgttatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaccagattgatttamagcatcctctttagcaartaaawgtactgcaccaagggctaattcagctcctttttctaaaccactttgttgagctttcaagacytcaatrgttttcgcattttcttcttcaactaactgatagaattttgtttgttcatctgcaggcaagccactcagccaattattaaacgctccagataattcatctgcaagaccaacagctttcaataattcatttggtactgttactctacattcaatctcacaattagcgaacaattccgctcgttgtttttcacttaactccctgaatttcttatgaacttcatcaacactttcaccattttgaatagctgcttttaatgctttttgatattgataaacatctttaagagaaagggcgttaaactccactgcacttttcccaatctcgccacctaatgctgcattttgcaatgtatttgctgtagtgttcgattgtttgtttgcctgtgaagtaacaccacctgcaaccgcccctgcaattgaacttaaagtgataatatgttgccgttcttctgctgtcaattggctcacttcggttttgttgtacagcaatttagccaaccttggagctgccagctctgctgttgctgctgaaactgcacctgctgcggcattgccatctgcaactgttgcttcaattgctccccaagtggcgtgagccaagatatgaagtggcagattaacatcaccattttcatcggttgttgcctgttttatcaggttattaaccgttggaccggcaagttttgtccctatcgcccccgcactttgattcgctaatacaccggttaaaacagtggtcaataccttggctgttctgttgtatgtgccattgttatcccattgcttttgtgcttgtgttgcttcaataagtgcggtcagttttgcttcaatttctgatgaacttgcattcggattcccttgcacttgttctaaggatttttctgccaagtaagaataggctttatttaatattaaatttatttgatattattttttttatacataatcctataaataaaggaattgcaaaagataaaatatcacttaaagcatcttcagcccaataaaaatcaccaaatttccaatagatatatataaatatccctatatgctttaatgccgcagcagaaaatactgccaaaaataatgcaattaaataaattatcgtcttgatcattttgacaactccttgttattaaggtatttctttactttttcataatcttttactctattatcaaaatctcctccatactctccaaaagcaccgccaagaatatttccaaaggtagaatctttaaggctaaatggcttatttattataggagaaactattgcactgaaataatcgctgcctaaggtatttccactaggatcttttgataagctggttactgttgcaatacctatattaatcctaatttgattacccaatgatcgatttctggttaaagcacctcctgaaaatgcacctaacgcatcataaggattaatatcttgccctgtaactgttttatatcctacatgagctccaagcgaaatacctccatcaatcaacattccagtggtgttaggatatttagtcgaaaattctcctattacacttgcagttgtttttgccgcagatgaagctcctttagctattttaccaacgtattggacaccttttacagccgcactatgtgctcctgttcccacaaatgaaagccctgttgcaagagagttgctcaaacgtccttcaaaactttccgaatagctatatactctttgagctcttaattttaaatcagaataatccggttttatttgtggtgaatctattggtgtattcaataatctcatttgagctggtacatcgctatattcctttacccacttaaacaggatttctctatctttttgagtaagggtatcaggactggtttggtaggtatgtaataacttgtctgaaacctgatctttctttaataaatattggattagtattgcttcttcaggagttaatatttttttctctactaatctatttaatttagcatattcatgctgtgataagaaattatttttcaccgcactttttgctgtctctgctcctaatatcgttgatgaagtattgccacccgttacattgccgacaatcaaaccacttagctgtgaagccactttgaggagtgtccgttcttcattgtttaattgctctgccgatttattgaaaaccrcatccgaraggaacattgccgtagyctcacctgccacaccggyagtcgctccgacaagggcatttgtacctgatagatgtgcttcagtagyagaaagtaaagcgtgagctaacaaattagccattttactgtcttttgtcattgtgtgaatttgtgcattcagctcmggrgaaatcgcarcarcgacaacttgcccagcastgccaccacttaaaattgcccctaccgtagcaacgacagcatcaagtttacgtctttttgaaccgccctcttgccattccacatmttgtgtttcttttgccttgttattggcataaayattkrctgcykractaatatrysmcactgccygagcaatctccttttgctccgccagtagttttttcacctcttttggttttgccacttggctgtttgcttggctaaggtcggtattaatycccaacgcttttgctgtggtttkgattgggtttgtgtctttgtttaaggtgattttcccttccgtaagcgtcgctttggtgattgagctgtcattactttgactatgcatcggtaagctcggggttatgttcggagcggttttgccgtaagtgcctgagattgaaacacttgttgccttatgacttgattcatttcgaatgtcattaaaagtgaggcgattggttcgcagttcactgttgtttggggtagttgaagcaatggtactgcctttcaagtggacgttgtttgcctctatatgataaccgcctttgcctgcaattaaacctgcctgttcattaacttgtttataactgcttttacctttctcacccgaagcaaaaccgctcacactccaagcattaccaaaactcacatctacactaatccctgcctgactgcctnnnnnnnnnnnnnnncgactgtcttgcaatctttcgccgttttctccccgtccggtaaagtccgtctgtgtcgcctgaatatcaccgcttcttgccctaatctcaatctgtttggcgttgacggtgttgccacttgtatcaaatacaagcggtacacttaccgctaaaatttgcaaaattttaatcaaaacaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatttgttagataactgttaacctgttcacctaaagaatatccataatgattttcatatatatgagcataaaaactaatacttgatgcttctgtaggaaagaaactccatattttttgacctatagcttgatagattttttgaatttccattatttactctcttgttggtgtatttctataaatttcatttattttatttcctccattgactttataggaaatttagcataaatctcttctttcctattcactctgtccctccaaatttctaaaggaatataatattccttagtttcttcttcagttagatcacttattcctttcatatataacatattccaactatcttcctttggtgtataagcaaattgaatattgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncactgcctgagcaatctccttttgctccgccagtagttttttcacctcttttggttttgccacttggctgtttgcttggctaaggtcggtattaatccccaacgcttttgctgtggtttggattgggtttgtgtctttgtttaaggtgattttcccttccgtaagcgtcgctttggtgattgagctgtcattactttgactatgcatcggtaagctcggggttatgttcggagcggtttttccttcaaccaacatcgcattttctgctccttttttgctcagtttgccggtttcactatcttggtagtaatctgctcctttaccgtaagtgcctgagattgaaacacttgttgccttatgacttgattcattttgaatgtcattaaaagtgaggcgattggttcgcagttcactgttgtttggggtagttgaagcaatggtrctgcctttcaagtggaygttgtttgcytctatatgataaccgcctttgcctgcaattaaacctgcctgttcattaacttgtttataactgcttttacctttctcacccgaagcaaaaccgctcacactccaagcattaccaaaactcacatctacactaatccctgcctgactgcctttgctgttgtaattgttgctgtcttgcttgctttcaatccgaaggtcgcctttagcattcacatcaattcgctcagcagtagcggttgtgccgttgagggtaatgctcccttgactgttaaacttaatatgttctgcatctaaatgactgttatggtaagtggaactttctccgttggctttttgactaccgccaccgacagtagcataaacccctacacccgtttgtgctcctgcttgagcaaacatacctacttccacacccacattttgcccacgggatttttccttgatccggctttcacctgcttctatttctatcttgtttgcatttagctcaatccgactgttttcaaggcggttgccgtctttgtcttttgacacaatatcagcatgctcaaggcggatattacctgtaccgctttggttgtgatttgccctcgattcagtcgataaagtgcggtcggttttgttactgttttgtgcgttgctttctgtgttatcatctcgagttgttagcaccacttctttgccatttaacacattcccttgactgagatgagcttcactttcctgtaattggcgactgtgagcgacacctgtgccactttctactcgtatcaaataaccggtattcggcgttttattggcaattttataaatgctgtcggctaatgtataaccctgagccgccaaacctaaggcttgtgcagtctgaagccttgtagaggcctctttgttttttaccacccgttcaactgtttggataatatcaataatcggcgatttgatgcgactaaattgtccgattttcaaatcactttgactttgttgttgtgtttgctcattatgagctgccactgcttcaatattctctgcggtaatatgcagtttgtttttcgacagtatttgacttgaggtttgatgataatccttgcctgcattgatttccacattaccattaagactgacaacttgactgccttgatgacggagactatcaccaacttgattaaaccgctcacgatgataaccaaagaaacgctctgtttctgatgtcgccacctcaccaatggcgtgattttttctcgcttggcgttgagtttgtgtggtagtcgccgtcgtaaaaagaatatcacctgtcgcactgaagctgttattgccttcacttaccaacactaaacctttacctatgatgtcgccctgttgagcagtggtttggctgtttccgcccacggaaatcaccgtgcctttttcctcaatcaacgattgcttgccgttttcacgccctttgccaacacctgctatatatttatttaacccgttaagctcaaatcccttactggaactgttcgccgattggctataacggttgatggctacatcaaaatgaacatcgccggcagccgtaaaggtcgcatctttttccacagataaagttgcaccttgggtgatgatatcgccaccggtagcgactaccgttaaattgccttgcgtgtctatgtttgcactttgagcaatcacctgttcagtttgtttgttggattgatgactttggtgcttgatgtaaggctgaatacctcgcattatcataccggtagtatccgtaatagcctctgcacgtgaaagctcatcaccaacaattccatttgtaacaccttgatctcgacgttgtttgtatttttcttttcccacctcaatcgggttatacaccatattcacaccaaccccaccggatttgctgacatagcgactttgcccaaggtgatgctcttccaccgcattgatatttaccttactaccttgaagatgcgtatcgctactactatggatttcggtagcattcaaggttaattgatgttgagctattactcggatattgccttttgcattcagttgtgttgcaaccacatcctcattgcgacttcgattatttgattcagttttattgcgttgatagcccaccgacacaacaccattcgaaagactaccactcaaaccgctttttttggctttctccctatagtccgtcatttttgtattgatgagtacattcaaattaatgtcttttgcagtaatatcaatatgttgtttcgcatttatatcggtagcttcggtttttaatttatcacctgctacgagtgcaatactgtcaccttttaacaagctaccctgatagttatcttgctgttcgttatagtgcgtttctttacttttcttagaaatagtattaccgcttttatagcgatgctgttcctcaagtgttgatactgttttcattgccccaaataccatctcatttgttgcaagtgcggtcagttttttcgctgtttcaatcgccgtactttgcgtgtaaagattatcggtttctaggcggatattgctgttgctttgtatccggctaataatgaggttttgattggtttcttgacggcggtggtcgcctgtccctagtttttcactgtgttgggtggaaagtgcggtgctttttaggctgtttttaatattaagcaggctgtcacctgtgccactgttaataatatcactgccgatttggttaagattgtcggcgttgatatataatgtgccgtcttcgcctttcacgtggagtaatgccttacggtcaaggtgcatgtttttataatggtacccataacttggattgctactttcatcggttttcgtggttgagcggtgtgaaaatgtgccacttacattcaaggctaatctgctttgtgcttcaatgtgtccgccttcattagttaaatcccctgatgtctgaacataaagtcgttgggcggataaggtaccttgattatgcaagctatcgccatttaactgcatcacttcccgtccgaaaatcctgccttggttaatcagttcgctgttttttgcataaatgttattcgctgaaatcaggctgccttttgtggttaatggtgaaaaatctgctttgttcgctacaagatagactttcggtaccaatacttcttgttgacttccattaggtagtgtcactgtttcagtttccagccacacaatatcggaagtcaaccttgccctttgtgctttactcagtttcacgccaggtcgtagggtaaattcattcgctagagtttggctgaatttaactgccgaatccattaaggcttgatattgcacttcaaaatcttgctgatgccctgaagggagtttaccggttaattgataaagttgttctcgcacaaggcgttgttcatagtagccgtcgcctaaacgtttttgtacttgatttgagtcataacgaagagcattaaacatataatcactacttaaccatttacggtaatcggtaaaggctggggtggtttccactaaaatatgactgtccgcttgcggattgatttgataaagagaagaactcggtagtattgttgtcccttgtgtaaaacgaatttcacccttgccgtctgttattttaataaatggagctgtagtttgagaattgctttgtactgtcgtagcaacggcataatccccttgagtttgactaaataccacatttaatggaatagtcacattatccacggtatggcggtcatgtcgtcctccccatttgcgttggaaatagcgtttgaaccctcctcgccattttgaccaagtaaattcgtgattaccgaattcttccgtagaatgaatgccttcttcatcagtgtttttaaacggactattttcatcttgacttactaaatttccaccggacagtattagcgaacggtcattatgcaccgcaccttgaaaccacatatcgccaccagccaatattttacccggtgcggtttgtttcaccaccgtttggctgattttgcgacggttgaggttaatgtcccaaaagcgatcatagattttgttggaaaaggcggcgttgtgcttttcaattgccttttctaattgctcaaattgtgtctcattggctttcaaccaatctaaataaggtttcagttgcaatgaaagtgcggtctgttttgcctgatattctaacttgtttacctcataatccgctttttcggtttcatagctttgtaggcgtttagcaaaatccgcttctgactcattattttctcgagtgggtttttcgggttcattgggaatgtcaaaataggcttgtaacagatttacatcaggataatctttgagggtcaaatgtactttttcatctaaatgaatattaaaatgtgaccaagccccgtcattaggtagatacaaagaatgtggtttaatttgacaatttttcttatcggtaagattgctgcaactttcttcattcggcatcggtaagacataaccgttaaagttgccattggattctctctcttttaactcagttgctcgagatgctactttaccggctcgactaaaagatatccaacgcaaggtgttaaaatcaattttggcagaattaggttgtccttcgggtaataaataatgttcatttaattgggtatcactttgtaattcaaacgctgtttttaaatgttcgttactattgattaaggatttcactccaaaataagcattgccggccacatcaatcaacccactttgatttttaaaattatcggcaaaagatgagttttcagaagataactcgacttcctcagttgaattcaaacggcgaccgacaaacaaatccccctgactcaacagacttggaccttccgtgatttgaccgttttgcttttctgctatggtcaaaaattgtttttggtttatcagttcaggtgctgccaaatccaatcgtttatgagcggcaatgacggcggatttaacatcgttattattgcttgatagttgctcgtctcgattaacaatacgagcaccggcttcaatggcgactttatcgcctaatatttgtcccgtgccaatattttccaccgtctctgttgctttgataactgtcttttccgttcctaataccgcacctcggttaatcagagatttttcactttcaatccgattttgtcttcctcgaatcacaccgctcgaagtctgttcgatattctcttttgcttttacctcaaccctctcttctgcatacagcttgcctgcattatctaaagtgcggtcggttttaagacggttttttgtcgctgctattatttgaccggatgcggtattcacaatcttgccctgactatcaatcactatctctgagctacttgcaccaatatgccctgcattgcgtaccccaacgccgttttctgtaccgataagataaattttgcccgaatacattccgccaagctctgctacatcaagggaaaattgcggttgtgactcgcctgaaacgtgttgggttgtgtgaataatttgcaaagttttgtcggaatcaaaccgcttgatactatttttccctgtgataacggttgcttcttttttcgaccaaatccctgcattcacttccgcttctcgagcgaggatttcagtataatccacacgactgttgtccaagcctttgccgctgacattgactttaccggcttcaactttaaaactctccacttccccgtttttaatctcaggcttgcctgtagaaagcgtcactcgaccggaatttatcacaccgcaaccttcacaatgtagcccggagggattggctataatcacatccgctttgccgcctgctacttccacatagcctttcatcacggacggcgaagaagaattgatctcgtttaaaatcactttcgcctcaccttgggcgagataaggattagccgtcacctgccctgcaagttgggtagaagtgcttgtgcgactgttatttaaaattactcctttctcggcaacatcaaattgtgaatatttattatgggaaagccctttggtattgggcgtttgaatattgacttgcggaagcccattggtagtttgtaaaacaatcggttgttgggtttttggggcggatttatccgcttgaataattaaagtttcagcaaaagcagaagagaaaaacgaagaaaaagaaacaaactccaaggcacaaaacaaactgaaacaaagaggttttaacagagctaaaagcgaagaaaaatcgaccgcactttttgaacaaacagaagacgaacatgaagatttgtcttgggattttgcaagttctgatacaacgattaaacgttgtaaggggttactaaaaataatgcaaaaatgttgtgtgttcataataaatcctcctgatttttccgttttgattatcccaacctgccattcggcgtttttgtacttcaatttccgacttatcaatatagttttgcgattgatgtgaccaaagtgcggtggaaattgtggtttttctgtgactgtcacgataaatcaaataaaacaaaacaatgtgcgcttatcggtttcgctttcacctgaataaatatagctgttatcaaacgcccattgatggataggatagcaaggcaattcagtataagaaagcaaaagtgattcagggggagagatatttaggcgaatatcgggtttaggctgtgatttatcatcttttgcctgctgatgttgttgggctatatcgtttaattgagtatcaaatgtattagtgaaagtggtagtggatattacggaagaaattaagcttaaaatgagtgtttgatggcatttcataatatcaaatagaaaattatatagtcattctaagtagaatatagaatttatcattttttgcaaataatgttactcagtatttaggaaaagaagagtatggttgatattttgttgggatgttcggggaatattatcgggtatggtttagtaccgtttggtgatacacttacttcagccaaaagaaaaatgggagaaaattattctcctatatttatgttacggatagacaaactccgttttatcttttaaatggatggattttataccgaacacttcattccttttggagttttatgtcaatggggattggaatacatctgtcatctctgaatcaacttagcaaaatgcgatcccaccatgtattaagtaaaactattaaattacttggtttgtatgtgaaattacattacatagttttattagttggtgctgatcgctatagtttgcattatatttcaatgagattaagcagttgttgcagcttccattgagaataaacgtaatttattcattatataattcaataagataccgtaagcaggtacgaagaatagaatactaatgaaaattttaaataaataatctacagaaccgatttcgacccagtgttcagccataaacggatcgttacttgcgtagaaagcaataccaaagaatatgaacgtatccgccagtgagccgaataccatagagcaacttggtgcaatccaccaagtttttaatttacgtaaatggttaaatacatacacatctaatagttgcccaaacaggtaagccgcaaaactggcaaacgcaatacggaagacaaatgtgttaaatgatgtaagtacatgtaaaccttgatattggctatcggaaaataatgttgaaacaagatagctgatgattagtgcggggatcataacgacaaaaataatccatcttgcttctctagcaccaaaaactcgcacggttaaatctgtggctaagaaaataaaaggaaaggtgaaagctccccatgtattgtgaaacgaaaaattctccgcaaatcctaaagttgtgagaggaatggtaatttcaaaaggaatttgaacgaggtagttgcttgccgtaatgataaatatatggaagaaactcaagatgattaatgcacgttttttttgttgatcattgaagatcgaagagatgtttttcattttgtgtacctttttgataaataaaattggggttagggaacccaatataaacatgtccaaaattggagacggagaatgatactgaattaagaaaatatttcaactaatatttacaagccaaattgctatttttttgctattctacacgacaatttttatattacatttaatggatcacagtcatgagcgaaccagaaaatcttgcacaaaatcaaccgcacttttccaaagatacaacgcattttggatttcaaactgttgcaaaatcagagaaacaaaaattagttgccaatgtttttcattccgtagcggcaaaatatgatttgatgaatgatttactttctttcggcattcatcgagtttggaaacgctttactattgattgtagcggagtgagaaaggggcataaagtcctcgatcttgctggtggtacaggggatttttccgcaaagttttctcgtatcgtaggtgaaacgggaaaagtgattttggcggatattaattcttcaatgttggacgttggacgtgaaaaattaagaaatcttggtatcgtgagtaatgttgattatgtgcaagccaatgcggaagaattaccttttgcagataatacgtttgactgtgtgataatcagtttcgggttgcgtaatgtaacagataaagacaaagcattacgttcaatgtttcgggtattaaaaccgggtggacggttgttagtgttagagttttctaaacctattttggatcctttaagtaagatctatcatttttattcttttaatgtattgccaaaaattggtgaaattgttgtgaatgatagtgacagctatcgttatttggcagaatctatccgtatgcacccgaaacaggacatattaaaagagatgatgataaatgtcggttttgaacaagtcggttattataatttaaccgccggtattgtggctttacaccgaggctataaattttaggatagagtatgttgcctgattttaattctttgaaaacacagtttatgttaccgcagtttattaatgcgggatgtgaactgttattaaattatcttttgcgacggacaagtcatcgtgaaagatacttgcgtcaattacaaggtaagatcttaaagctgacattacaaaaaacacatttttctttgtatttcgttttttcagcacagcaagtggatttattgaaccattatgaaggtgaggcggattgtacagtggatattgcggtaaatttattattgcaaatgccgaaaaaatcggaaataagtcgatttattaatgataattcgcttcaatttagcggggatttgcagatattacaagattttgtggagttaatggaaatgttggaaaaagatccggaagagctgatttctccttatgttggtgatgttgttgcacatagtgcggtcagttttctcaaaaaattgacgaaagcaataaaatatcggcttacacaaagtcagcaattttggtcggaacgtttgaccgaagagtgggcggtactttcgcccaaattggctgttatggatttttgcgatcaagtggaaagtttagcaaaacagaccgcacttttagaacaaaaaattaatcagattttagcatgatgaaacttaatgatattaaacgcttatataaaatagtacgtgtttttttgtcttatggtattgatgaaattctaccgcatagtaaatatactcgcccaattcgttgttggcgtaagttatttttctggttaaaaaatcaacataaaaataaagcgtttggattacgtttgcgtttggctttacaagagttaggaccggtttggataaagttggggcaaatgttatcgacacgtcgtgatttatttcctgcggaaattgctgatgaattggctttattacaagataacgttgaggctttttcaggaaagattgctcgtcagcaaatagaacaagctttgggttcttctctagaaaattggtttacagattttgatgaaaatgcacttgcttccgcatctattgcacaagttcatactgcaaaacttaaattgggcgaggaacaggaaaaggaagtggtcatcaaggtgttgcgtccaaatattcagccacaaattgaggcggatttaagttggatgtataaattagccgggttactgcccaaattatttcgtgaggggtatcgtttaagagcggtcgaagttattcaagaatatgaaaaaactttgcgtgatgaacttgatttacgtgtcgaaatggcgaatgcaataaagttgcgagaaaattttcttgatagcccaatgctgtatattcctaaaatgtatgaagcattctgccacaaaaatgtgattgtgatggagcgtatttatggcattcctgtttccgatgttgagacattgcaacgaaacggcaccaatatgaaactattggcggaacggggagtgcaggtcttttttacgcaggtatttcgtgacagttttttccatgcggatatgcatccgggcaatatttttgtgaatcctcattatcctgaaaatccgcaatatattggtattgactgtggcattgtggggaaattaaatgagagtgataaacgctatttagccgaaagttttgtggcattttttaatcgtgattatcgtcgggttgcacaaatgcacgtagatgccggctggaccccacaagatacgaatattgatgatttcgaacaagcatttcgagaggtatgtgaaccgattttcgccaagcctttatctgaaatttcatttgcacaagttttactgaatttatttaatgtagcacgtgaatttaatatgcaagttcaaccgcagttagtgttattgcaaaaaacgttactttatattgaaggattagggcgtcaactttatcctcaattagatttatgggatacagcaaaaccctttttgcaaaattggttgaacgagcaaataggtatgaaggcaacatttaaaaagttgaaagccgaattgccttatttgcaggagcatctacctgattttcctgaaactttaatggacgccttgaaacaacaaaaatttattagtcagcaattagtggaaattaacaagaagttagctaaacaacaacgttggcaaaagaaaatgtttgtattaattgtgggaatagtgattttttctgtaacgttatggcaattcgctgcattgccgttggcgataagtgcggggttattcttagttggttttttagtttggctaatcggttttttgttaccttaatgcgttagatcaaaaataatccagtttagctattgtcactatgatttaaaatggttatattctgcaagattttttattaagtttaatgtcataggagaaataaaatgggattaagttggcaacaattactaattttgcttttagttgttgtggttattttcggtactaaaaaattaagaaatattggttcagatcttggcggtgcggtaaaagacttcaagaaagcaatgaaggatgatcaacctaaagatgccgaatttaaaaaaatttccgaagaggtagagcaaacttcagtcgaaaattcaaaacaaaaagagcaggcataatctgtgtttgatattggtttctccgaacttgttttactttttgttgtgggcttgatagtactgggaccacagcgtttgcctgtagctgttcgtacggtaatgggttgggtaaggactgtgcgaagcttagcgacaaatgtacaaaatgaacttagtcaggaattaaaactgaaagagttacaagaaagcattaaaaaagctgaagatctcaatatttcccaattatctccggaacttagtgaaaccgtagaagaattacgtcaatcagcacaaaaaattaaaatgaatttagaggagaaagctgctgaaacaaattcttctgttgaagagcaggtgcaagaactgaaaagtgcggtgcaaaattcacagggtactgcaacgactgaaatagaaaaaaatcttgattttccttccagtgagttatctcctgctgaacttgcagagttagctgaggaaggagagcctatgctggaaatgggagaatctgatttttcagaggatgagcaggcgactgcttcatctaacgaaaccattgaaaatatcaaagaaaaagtatgactgtcgaaaaatctcagcccttaattagccatttattagaactgcgtgatagattattacgttgtatcgtttttgtggtcgtaatatttctcgccctagtttattttgcaaatgatatttataactttgttgcctcgcctttattagatgtattgcctgccggtgcaacaatgattgcgacgaatattgcgacacctttctttactccgattaagttaaccgcagtagttgctttatttatttcagtgccttttctgttatatcaagtttgggcatttgttgctcctgccttgtatcaacatgaaaagcggttggtatatcctttgttgttttccagcacattgttgttctatctcggtgtagcctttgcttattatgtggtattcccattagtatttgcttttttaactaagacagcaccggaaggcgttgctatcgctacggatattagtagttatttggattttgttttagccctattcttggcctttgggatatgttttgaagtgccggtagccattgttttattatgctggagcggtgtgactacgccggatgatttaagaaaaaaaagaccttacattattgttgccgcattttttattggtatgctactaacgcctcctgatgcgatttctcaaacattgttggctttgccgatgtgtttattatttgagataggtgttatttgtgcgggtttttatcagccaaaagatgaacaggaaaaatcataaaaatgatttgaatttgagtgaataagattaaattatttgctctagtttgtagaaaggattggaaaatgactaaacaaatatttaccggatatcctcaacgccgtttacgtcgtatgcgtaagcaggattttagtcgtcgtttaatgtcggaaaataagctgacagtagatgacttgatttatcctgtgtttattattgagggagaaaatcatcgtgagtcggtgccttctatgcccaatgtggagaggttaacgctcgatcaactcttacttgaagcggaattgttggtgaaatacggtgtgcctgtcattgcactgtttcccgttattgaacaagagaaaaaatccttaatggcggaagaggcttataatccggacggtttagttcaaagagcggtaaaagcattaaaagcaaattttccggaattaggcgtgctgactgatgtggctttagatccttatactgttcatggacaagatgggattattgatgaatatggatatgtactcaatgatgtaacttctgatgtacttataaaacaagccctttctcatgctcaagcaggggcggatattgttgcccctagcgatatgatggacggtagaattggtagaattcgtaccgcacttgaaaagcaaggctttgttaatacactcattatggcttattctgctaagtatgcctcaaattattacggaccatttcgtgatgctgtcggatctgcatcaaacttaaaagggggcgacaaaaaaacctatcaactggatcctgctaattctaatgagggattacaagaggttgctcttgatattgaagaaggtgcggatatggttatggttaaaccgggtatgccctatttggatatggtttatcgagttaaagatcaattcggcgtgccgacttttgcttatcaagtatctggcgaatacgctatgcacatggcagctattcaaaatggttggctaaaagaaaaagaatgtattatggagagtttactttgctttaaacgagcaggtgcggacggaattttaacttattttgctaaacaggtagcggaatggttgtatttagacgaaaagaataaataatttaaaatagattttactttaacccacttcgtgttagcgaagtgggttttgtttatctacaattgtatgtctaatttatcataggctcgagaaactttttctaacgccttatcaacagaaatatcacgtgcaagaataacacctaaacgacgatgcccattgacttcgcctttgccgaataagcgaatattagtattaggttcttgtaatacttcgaataaattaccaaattgtacttggttagatttgccttcaacgacaatcgcttttgaggcggctgggctaattaaattaatttcaggaattggtaatcctaatatagctcttgcatgaagtgcaaattcagaaagctcttgcgagattaacgtaaccattcctgtatcatgagggcgaggagaaacttcattgaaaataacatcatctccacagacaaacatttctacgccaaaaataccgcgtccgccgagttctgtagtaattttttcagcaatatgttgagcatttgcgagagcttgctcagacattgcttgcggttgccaagactcacgatagtcccctttttcttgacgatgtccgataggtgctagaaatgaagttccttctgcatggcgtacagttaataaagtaatctcataatcaaatttaacgaaaccttcaacgatcacacgaccggctcccgctcttcccccttgttgtgcatagtcccatgctttttgtaggtcgtctttgctttttaagatactctgaccatgtccagaagaagacataatcggtttgatcacacaaggaatgccaaggttttcgaccgcactttgaaagtcatcaaaattatctacaaattgataatttgatgttggcaactttaatttttctgctgcaaggcgacgaataccttcacggttcatcgttaattgtgtagctttagcagttgggacaacattaaagccggcttgctccaattcaactagtgttgaggttgcgattgcttcgacttccggcacgatataatttggtttttctttttcaattaatgctttcaaagcatctccatctaacattgaaatagtgtaagagcggtgtgcaacttgttgtgccggtgcattttcatagcgatctaccgcaatcacttctacaccaagacgttgtaattctataacgacttctttgcctagttcacctgaaccaagaagcatgacttttgttgctttaggtgttaaagctgttcctaatattgtcattttttgtccttttacattgtgttttttattaaaataagatttaagaattgagtaaattatcatctaaaagtagatcttcatttttattaatacctacgcctcgattaagaatattccgtgcaatattatgtgcatcttccaatgaatgttcagtataggttccacattgatattcgtttagttcaggaatttcggcttgatttttgacgtttaaaatatcttgcattgaagctgaccaagcgtttgcaacttgttgttcattcggcatgccaattaatgacatataaaatccggttcgacagcccatgggcgaaatatcaataatttcaatttgttcactatttaaatgatcacgcataaatcctgcgaataagtgttctaaagtgtgaatgcctttaggagagaggatttctttattaggaatacaaaaacgaagatcaaaaacagtgatattgtcgccttttggtgttcgcattgtttttgcaacacgcacagcaggggcattcattctcgtatgatcaactttaaaactgtcaagtagtggcataatttttcctttagagagcattaaaatagattattgaccggtattgtatttacctagaaattgtattgtaacgtattgctataacaaaaacctgattttttatgatataggtcatgatttttaatttattgtcgataattttaaattttatgtagattttctttattttattgagctttatactttttcttatcctatcaaattaattcgtcttttttttataaaaatagggtagaatagccgatcgaataattcaacataacttcgcaggagaataatcatggtaactcgtagggaattggcaaatgcaatccgttttttaagtatggatgcggtacaaaaagcaaaatctgggcatccgggagctccgatgggaatggcggatattgcggaagtattatggcgtgattttttaaatcataatccgactaatcctcaatgggcaaatcgtgatcgttttgtgttatctaacggtcatggctcaatgttaatttatagtttactgcatctcaccggttacgatctttctatcgaagatttaaaacaatttcgtcaattacattccaagactccggggcaccctgaatacggttatgctccgggtattgaaaccacaacgggtccattaggtcaaggcattactaacgctgtaggcatggcgattgcagaaaaaacgttagctgcacaatttaatcgagcaggtcatgacattgttgatcatcatacttacgtttttctaggggatggttgcttaatggagggtatttctcatgaggcttgttcattagccggcacgttaggtctaggtaaattgattgctttttatgatgataataatatttccattgacggtcatgtagatggttggttcactgatgatacacaaaaacgctttgaggcttacggctggcatgttattcctgctgttgatggacataatgcagaacaaattattgaagcaataaaacaagctcaggctgagaaaaataaaccaactttaattatgtgtaagacgattattggctatggttctccaaataagcaaaatactcatgatagccatggggcaccattaggtgatgaagaaatcgctttaactcgtcaagcattaaattggaattacgcaccttttgaaattcctgctgatatttatgcaaaatggaatgctcacgaaaaaggacaagtggcggaaaacgcatggaatgaaaaatttgccgcttatgagaaagcttatcctgaattagcggttgaatttaaacgccgtttaaatggggaattaccggcaaactgggcaacagaaagccaagcctttattgaaaaattacaagcaaatccagccaatattgcaagtcgcaaagcgtcacaaaatgcgattgaagcgtatgcaaaattattaccggaatttttaggcgggtcagctgatttagcggggtcaaacttaacgttatggtctggttcaaaacccattcgtgcgacagaaaatatagatggtaactatattaattatggcgtgcgtgaattcggaatgtctgccattatgaacggtattgcattacacggcggatttattccttacggtgcaacgttcttaatgtttatggaatatgcacataatgcagtgcgtatggcagccttgatgaaacaacgttcattatttgtttatacacatgactctatcggtttaggagaagacggtccgacgcatcaaccagttgagcaaacaaccgcacttcgcttaattccaaatttagaaacatggcgaccttgcgaccaagtggaatctgcaatcgcatggaaagcggcggttgaacgtcaagacggtccaagtgcattaattttcactcgacaaaatcttgctcaaatgaaccgcacttctgagcaattggaaaacgtgaaacgtggcggttatatcttgcgtgcatgctgtgaaaaaggtgattgcccggatttaatcttgatcgccacaggttctgaagtggaattagcgatgaaagcagcggaagcgttagatgcggaaggcgtgaaagtccgtgtggtatcaatgccgagtacgaatgtatttgataaacaagatgttgcgtaccgtgaggcagtattaccaagtgcggtgactaaacgtgttgcaattgaagcgggtatttcagatttctggtacaaatatgttggtactaacggacgtatcgttggtatgaatagcttcggtgaatcagcaccggcagctcaactgtttaaactctttggcttcactgttgaaaatattgtggcaaaggcaaaagagattttataatcagttaaagtttaattttgtgagcgggtaaatttacccgctttttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagcgggtaaatttacccgcttttttttgctttttggttaagtgaagaataaaaactcaaatagaataatcgctattttgtcttaatagcattgagttagatccccctttaatgtaaactattgtcccgtctttatgggaagttgtttgttgtcaaagcaaattctccaacacttattttcatatcaaaaacacataggtttaatatggctaccaattatatttttgtaaccggcggcgttgtatcttctttgggaaaaggaattgcagcggcatctttagctgcgattttagaagctcgtggcttaaatgtaactattatgaaactcgatccttatattaatgtagatccggggacaatgagtccgacacaacatggtgaagtttttgtgactcaagacggtgctgaaacagatcttgatttagggcattatgagcgttttattcgtactaaaatgacgaaacgtaataactttacggcaggaaaaatttattcagaagttttgcgtaaagaacgtcgtggtgattatttgggtgcaactattcaagttattccgcatattactaatgaaattaaatctcgtgtcattgatggtgcagcaggatatgatgttgccattgttgaagtgggtggaaccgttggtgatattgaatcgttgccatttttagaggcattacgccagttagccgtccaagttgggcgtgaacggactatttttatgcatctaactttggtaccttatattccaactgccggagaggtaaaaaccaaaccgacacaacattccgttaaagagttactctcaattggtattcagcctgatgtattaatttgtcgttcagatcgcatgattccacctaatgagcgtgcgaaaattgctcttttctgtaatgtaccggaaagagcggttatttctttaaaagatgtatcatctatttatcaaattccggctttattaaaatcacaagggttagatgattttatttgccaacgtttccgtcttgattgtcaagaagcggatttatctgaatgggaaaaagtgctttatcaagaagcaaatccgacaggtgaagtcactattggcatggtaggtaagtacacggaattacctgatgcttataaatctgttaatgaagccttgaagcatgcgggattgaccaatcgtttaaccgttaatattaaatacattgattcgcaagatgtagaaacaaaaggcatagatattttaaaagatttggatggtattttaattcccggtggctttggctatcgtggtgtagagggcaaaatcttaacagcacaatatgctcgtgaaaacaacgtaccttatttaggaatttgtttaggtatgcaagtggcgtttattgaatatgcacgtcatgttgccggactaaaaggtgcaaattcttccgaatttgaccgcacttgtgaatatccagttattgcgttaattactgaatggcaagatgcagaaggtaatgtggaagtgcgttctgatgaaagcgatttaggtgggacaatgcggttaggtgcacagcaatgtcatttagtcgaaggaagtttagcacatcaattatacggttcggatattattgaggagcgtcatcgtcatcgttatgaagtgaataacgttattcgtccgcaagttgagaaagcaggactgaaagtaacaggcttaagtgcggataaaaaattggtagaaattatcgaagtaccaaatcatccttggtttgttgcttgtcaatttcatccggagtttacttcaacaccacgtgatggacatccgctatttgcaggctttgtaaaagccgcaagcgaaaaccggaaaaaataaacgtgcagaaaataaaaatagcttgggaaatccaagctatttttttcttattgatatagttccgacacaagttgaggagagagcaatctttctttttcatggaatagggttcccatgtagtaagacccgaacggagtaaaatgatcttgatcgccataaatagatttatttcctacataaactgtatcacctaaatattttgccgcattaacccatgtaacattcggaatgtttttaattaattggaagatttcattgttgcttgcggtattgtccgccaatttttggatcggatttaaatatttatctaagtcatattttgctaagaatgcatttctaagagcggaacgatttaacgagatattattcgcaaacacatagactttttttgtttttgctagatgtttaaccatcgcttgaaatttttgatcaaaatcagaaattacaaaggaattaggattgaatctcggtacaggtgtaccgcctctttttaattcataaaacatggaaataaaaatgacaggataagattcaattttttgccagtattgcacacaatctttatcctcaaatgagaggcaatcacgaatgtttaagatatccgaacgccacccttcttttgaaccgacataatttaaaaaatcttctagatgccctgcatgcgaatcgcctatggttaaaattttacttggaatattgagaggcaatacttcttgttccgctttctgagcttgtaaagcagaagttttatgctttatatgagaacgtacacttaaattgtagccgatgacaactaatgatgggattaaatataataggaaaaaagactgtttaaaggttaatttagattttctaataggttgttccaataaataataacttaatgccgaacaaataaaagtgagtacgatgattgttgacatcctcccccgcctaaaggcaggggattcctaccagctcccacagcaagctgtgggctactctcggcgggtttctactgctgatctctattgagattcacttcatagacgcttcgggtatgtcctaccctgatatttattatgcttgaactattgcttgcccacgtgtgagaacattcattgctcctactacatcggcattttctgtatagccacattctacacattcaaaatttgcctgtgtttggcgattttcttttgcggtatggttgcaacaagggcaagcacgactggtattctgtgctggtacggcaactaaaaatccgcccagccattgcgttttatagcccagttgtcgtctgaactcaaaccaagactgatctaatatcgcacggtttaagcctgatttctgtttcacatttttaccgtgttcttccgctgtgccttttgccgatttggacatattcgcaacttgcaaatcttcaacatagatcattgcgtggtttttgctgatttgggttgagattttatgcaaaaaatcttttcggcagttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagaaacagagattagacgtggtcgccacgttgtttttaacttacacgttcatttagttttcgtgactaaatatcgcagagaagtttttactaaatttattcttgatgacttaaaagcgatttttgaatccgtctgttcggattttgaagcaaaattagtagaatttgatggcgaagacgatcacgttcatttacttgttgaatatccaccgaaagtagctatatcaaaccttgtgaacagtttaaaaggcgtttcaagcagaatgattagaaagaaaaactatccgagtattcgcaaaaaattatggggaaatcagctttggtctccgtcttattttgcaggaagttgcggtggtgcacccatatctattattcgccaatacattgagcaacaacaaacacctgagtagttaggtttgaaacggctatgccgcttgtgccttatatccacgccctcaaggacgtggttttacggcactgtatggtaaaaaattgtccgcactttgtaaagtgatctaaatcacatttttttaaaatcattgaaataatcctgttatttgattaattttggtctgtagtgattgctgttaggctctttcgcatactcataaacgacaatagggcttttgtgaattgtgatagattgatatttatcaaaatctaatcctatctttctcaatcctttaaatatctgccctttgtgcgtaaactccgcaatattttcattgttgccgtctatggttttgcctgttaccacataaaaagcctttattctgcgttttggtttttgcatttaatcaggctcgctaattaattgataaagtgcaattccgccatgtggttgccctgtatggtctatgctattaattcttgtggtttcgatttgatagcctttctcacgtaactctttaattctctgtgcgggcgagacaatccccatctgcctaaaatcaaaagtacttgagctacgctctctcaatacctttaaaatagttctgcactgtgtcgcttttgaattgtcttttagaactcctaccatgctccccccttaacttgcgatatagctttcaatatcagctaaccgccaacgagtagaacgcccacacttcttcgcctttggaaactcgcccttattcattagcttgtaaattgtggtagtagaaaagcctgtaattgctttcacatcttcaatattaattagtttcttttggtaaggttgaacagattgagcttgttcaatagtttggatagtttcgctttgtgttgtcataatttcccctttcggtttggtgttgtttgtatgtggggaattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaacgcccctattcgtttccctatctagtgagggtgcaacaagagatagatagggctattccctttcggctcggttaattactccgtgcctagttgcaccaatttgaaaattcatgctttgttgttatatataaaacaatcctttcttcttgtctatttgtatttcttcggttgtgtttctattttactgtttatttttacagtcatcaactaaattaaacaatcgtaataaatgcgtcataaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnataaaaagccttgctagataacaaggctattattcattgaattgattttagattattcagaaagtgttaataatattccgcacttttcgcaataatccccccatgcttgatatgcttgctttctttcctctaggtaatcatatctatcatatatagcctgtattttccctttccctgttgaattgtgtgctattgccaactctccaacgacaacagaaaagccaatctgactaagataggatctaaatactaccctcaacccatgtgcgtcttgtttatctctatagccgttatcccttaacgcattacttacagtatctagtcctatggttttatttctgtttctcactctggggaataaataagggcttgagccgttaaattgcctaattgtgcctataagtttaatcatttgtgaggataaaggaattatatgatctttgggctgttctcttagctttctagtttgtttcatgttctccgaggggataataagcaacttattatcatcatcaataaaaacccattcaatgcgtgttagctctttctgtctcaaccctgtgagcaaagtcaagttaaatgcaaagagtgtgttaaactctagcttaccctccttgaaagcggtgtttattgcctttaatagctccggtagctctgcaggtgtaatagctgggtgattttttgccagtggtgctataaaatcatcttttgctaaattgcaattatgcccctctataatgcctagcttaatgccataatctagagtagctttgacaagtctatgtaatttatcaagagtattgctagcccctatttctctgtaaacgtctattaataatctaggtgttatttctgaaagtggtatttctgcgagcttggggaatatatgcctttctaacctttgccaattcctcgttctagtgtcttcattgggtgcttttgttgggtatatttcagcataccatttagcacaaacatatttaaaagtgtttcgttctaatgcctgtgtgttttgtttttggtctctgtgtgttttaggatcgatattttgagcgagcagggctaaatactcgtctcttatctttcttgcttgtagtagtgatatttcaggatatttgccaatgctgatttctgtccgctttttagtataaggcttgtaatagttaaaacgccatatctttgaaccgctaatttctacagataaaaaaagcccgttgccgtctcttaatggataagctttttttttaatcttcgctttttctatttctgtatttgaaagaggtttgattaatcttgccataagtttagtagtataaaaaagaaaaaaataaagtgctttgcaccctttaaaatcaaggctctagcggtttttagtagtataattttttagataaaaatgtattttttgattttatactaccatttatactactaaaattcattgctttaaacatataaatacgaataaacacaaaagaagaaaaacaataaaagcacgttaaagccagtatttacaagggtttatttaatgaatttgaaagagtgggaaagaatggaaaattgaagttggtgccagtggtcggactcgaaccgacacgcttttaagggcggcggattttgaatcaagtgcgtagaactgttcaaataatattcgcaaatacacacttactacgatgtatccagccaatacatccactaggattttctgtccgaattccagacgatcctgatcttacacattctttcaagtttgtaaagcctgataatgattttatagtatattttttacaggttagattacaaatataatatatactagcttgactttaggagataatcattataatctgattgtcaaggtggcgttaccttaataacgcaatgagttgttggctcatcgtcaatctgatattaatctaggatgtaaaggcctagcggtggcaggcaccagaaaactctgatactaatctaggatgtaaaggcctagcggtggcagacaccagaataaaccaacatttaggcccacttaattgtgggcttaatactttatgaaagaagcaaatatgactaataaatttactggatacaaaaaactaagcattaatgacttgaaaaaatttgagtataatttagagcatataagaaatgccgcaatctttttcaaagatcattttcttagtaaagaaatgatatatagtactgaaaaagaaagtacatccgttatctttcaaagaagcaattttatgcacttgtgcggaatatattatgaacccggtgcgagtgaattttttaatcttgccttattaaaacaaatagacctaaataaggtttatataaaaaatgatggcacaacattccaaaagttgtctgttttaagttctatagattttttaattaatccagagataactttgtcatcaggtgcaatttatttaaacctttcttttgataaagctcttagaactaaaaccagagtctttgctctcacattgataaatgacaatcacttatttattccacaatctttactgaatcttaggaccatgaatgatttccctaagggtaacaaaattattggtataaaatcagttcatttagaagataaaacagaaatcatctacttatagaaaaaagaataagagaaattatattctcccatttttmttttatcagagtaaattcacaatcttgggcatttgcattatcaaggcaatactcaaaggagctcaatctttgataaatcatcaacggagaagtcaattaaggcacttgcaagaacatttaaggatagtgatcatacttatgggaagctcaggaacttctcagaagctccgctgtttcttgactcaaagtcatcaagattaatttattagctgatttggtttcctatgccatatttaggcattatgaacataatgatagctcattttacgatcttataaagaataactttgatcatcataatggacgtattcacggtttatatttacgaaatacagaggatataatcccataagtatgaagtatagaagggcgatatcctctctaataataaactctctcaacatttctatgtcatactcaatatatcagagcttaatactaatatcattatgcattgacaatttctgaatgacatagatattttccggtttcttcattaattgagtaacagcggtatatcaaaatctatatagtacctaagaaaggcttacttgcttagaaatatattaaaaaatatcttttagcttattttgaagcatatcttactatcttatgaatacataggggaaaatattctaaatttattctagcgatatacagagctttatcattaatagtattaagggatttacatctaatttttagatgctctagatagtctttctaccatatgaagaattgtcgttttatcttgttctgagctatttctataatagcttaataaaatttcttcttctttagtaatgcttaatctttctctaattctcaataccccactattgagcaaaacattttttatatcagaaagtatttgatttagaaatttttcattttctttttgaatatcatctatcaattcctgtttcaatgccaaagtttccttagttactcctaaactagtttgtacagattctggcatatcatacacgtagtattcaaaaacattacctttcactccagagacacgccgtctacgccatttatcttttttagcatataagattataccttgtggtgttgaagggagccctcctacatctaaaagctctttaagagtataccattctttcatattacctcattgactttattttaaatttaagttaaatttaacttaaattgaattaactttaacttaaaagatcaaggctaattcaaggagatctagtctacattaaattgagtgctatttgaagatcgcttatctaaatgaggttttgtatgagttttgaacaattattgcatttatttttcttagaacggaatcatagacctgccactatacgttcttatcaaaatgtaatagcgcagattgttaaattttatccagataaagaacctgaacaaatatctaagcttgacttattagaatggagaaagtattgcctcaataaaatgagcccaattacttggaatagttatatcagacatcttaaagctatttttaattatgctatagataatgagctatttgagtaccctaaaaatttatttaaaggccttatggtaagacctgataagccaaagaaaaaactactaacagaaaggcaaatccattttttagaaatctctttggaaaatgaggagaaattacctcattatttacaacctgcttattttactaaagctttaatctacactttaaaatatacagctatcagacaatcccagctattacagctaaaaatttctgatatcgatatgacaagcaaaattataaatataagagctgaaaccaataagaatcatgaacaccatgaaattccaatttcagataaattatatccatacctaaaaagattgatattagaatcaagagctagaagcactagttcagatgagcagttatttaacattaatcgcttttcattagttactacatcaagaaataagaaaatgacagaaggacaactagttcatttttttcgccatatttctgaatttataggatttacagtaacttcacatcgattccgacatacaactgcaacagaagtcctaaagcaatcaggggatatctatgcagtgaagcaattacttggacataaagatctcactgtaactctaacatatattcacaatgatcctgaaatgctaagaaaacatgtcaattcgttgtagaaatgatgctacatagataaaataagggactgacgtagattagtaagtatgctagtctacgtcagccccgattttttaattaatccagagataactttgtcatcgggtgcaatttatttaaacctttcttttgataaagctcttagaactaaaaccagagtctttgctctcacattgataaatgacgatcacttatttattccacaatctttactgaatcttaggaccatgaataattttcctaagggtgacaaaattattggtataaaatcagttcatttagaagataaaacagaaattatttatttatacgctgaatttacaatccaagtgcaacaaaaaaagaagtactcatcaactagaatataattttgtttccacacaaaaaccacttccaaatgatgagtacttcctaccgacatcttacaataaacgagcgagaaaagataatgattttactcgcacagggcaaaaaacaagcagaaattgccaaagcactgggacgtagctccagcaccatttctcgcgagctgaaacgacacgctctagaaagctacagtgcaacgaacgcacaaaacagctatttgaagcatcgtcaaaatagcaaagcacagcgcaaattagagcagcctgaatatttcaatttggtgcaagaaaagttyctracrsaaaactggtcgcccgaacaaatcagcgcacgattaaaattgkaaaaatctgaattatccattagttattcaaccatttatcgtggtatttattcagggttgtttgatataggcgaacgcaaagccagtcgcaaactgcgccacaaaggcaaaacacggcatacaaaaaatcatcatgaaaaacgtggcaaaattcagatatccaaccatttgaacgaccgtcccatttcggcgcaaaatcgcagtcgctttggacattggraagccgataccgtactgggtaaagcgggtggagcttgtttgctgacgctgacggaacgcaaaagtcgttttgagttggtgaagaaaattcctgccaaaaaagccgaagcagtccaaaaagccatgattgaattgctggattcacatatattgcggtcaattacgccagaccgtggtaaagaatttgcccaacatcgtttggtaacagaagcactgggtgtagaattttacttccccgagccgcatcaaccgtggacacggggaacgaatgaaaayacaaatgggttacttcgtgaatactttccgaagcaccaagacatcaatcagtggagcgaagttgatattcaacaggtggtcaataaactgaatttacgaccgcgtaaatgtttgggttggaaaacaccttatgaagtttacttcaaaaaaacgttgcacttggtttgacaattcaagtgaaaattcagttgctgatataaaataatttagccaccttatttctaaggcggctattatttgttagtaaaatattagctcattatcatcaatttcatctaaaattgagatttgagataaatcttccactatcactgatttttctatattgttaccacagcctttctcagtagtgctatttacaagtggtgcaatttgttgctccagtttatgagaccaatttcccatcaaatgagccagcgtatacatttgaatttttgtttcattcaatagcgtatcaccaactacaatacaagcaggaatatgtaataacgatagctggatataacacatcatggcagctgtaaaatcaacatcttgacaatgaacccaaagttgttgttggggattgtatttcgcatcaaacatcgcattaacacaaccaatcaccattacacccgaaccacaagttggttctgataaagtaacaaatccctgttgtgagatgattctatcacagtcctgtagtgtaactttcgccattagatctgcgatgtgagatggtgtaaagtattgccctctataaccatcaccaagattgagattcataaatactgagcctaagaaatcatagcgtttttgtgttaaagcattcaccgtaacagctaacaattctgctaattgagtaaactcagaatctgaatatcgtgccttagcatgagcaaagcgttctcgcaaattaggttctgcttgatctcgatacgttactaggtacatatcaagtgcagagagtgtaataaaatcataaaacacttctgaacgtcgataatgtggtacgatacgttgaaataagctgataaattgcttttcaaagttttccattagactactccttaaagtttacggagtaatccccctagggaattacccctagggtggaaaaattaattaaggctattcaagtttctcttcgaactcatcttcaaattcttcattaaagacttcctcagcaaaactgcgaatacccctatcatctatgtaaatattgcagtatgagccatcaagatttgcgatatatttgcccgcaaaccacattcccggctcaaaaaatgaaagtataaactcaatgtcaggaaaggcagtacaaagtgcttggaaccaaccatcaggtggtccccatggcgtatcaaataggcaattaatagatccattatcattaaagctaacttgacagctatctgaacatacattccatttacagccccactgttcatttgaccagtcataccaatctttgtaaccatgttgagctaggttagacagatattgctggcctaatgcgaggtttagccataatatactttgttgttcaggacgttttatcaaccagttgataaaatgacctacatcccagcgatgatgctttgccttagcatatatccgatcaatttcggacccatagatatactttttgagtagagggcgtgttaaacgtctatttggtgaaatttttagaaattccattgctctatcaccaagactacttgattcaatgcagattgattctggcattggaacgagtaattcaaagtctaaacaccatttatcactttcagtttttctgaaaagcttaggaataatttgtttagcttggatacaatcgcaaaaaatttgtagtttattttcacaccagtttggcataatgtactcctaaataaagtaggggtacacttgccttgaggcaatgtaccccaagggttaaaagataatcgatacataattcctaaaggattatgtattactatgaaagattgtgttgaaagtacctttcagcaaagagttaagctgcttcttcaaagacctcgtttttatcagccagctgtgagatatttaatgcatctaacatatattgacaagcttcacgagctttaccagaagcccggacaatagcccgtttatcttcttttataactcttatccaactttcaatatatgccgcattttgaggtaccgtatcaaatccaaggtaggcacacaaaaatgctccccccatttcggcaaccaactcctcaaaagcatagactttgtttccaaattttgcttttccggaggtaataccctcacgatcgagccttttagcagcaccagttgcatgagtcatttcgtgcaataacacactatgaaacgcttgagcattttcaaactgttttatttccggcattacaactaaatctgcactgggttgataatatgcccgattactcggtttcatttccacgtgtaaatccattcctttgataatctgccgaatatcagcaaaaatctcgtattggtttggatccgatgtaggctgtttaggttctgatataggatcgtacagttcctcgggtaaattttcacactggtctagattgaacagattgtgcttcttaatgaaaaagtgttgttcaatttctggattaccttcctcgtcatacacaatatttccctcctcatcaagtttttctctcttatcaggacggtagttcattacaacagtagctttttcacctttacggatatatccgccgagctcgttagctttttttgctgtaatccacttactctgtttgtaaccgtattctgcggtagcaatccagagtaatagtgtgttgataccagaatacaatcggttagagaccgcattacgaggtaatgccatattacattctggatgactccacggttttaaccatggtgcagtcccctgttccagtgctgcaacaattcggtctgtgatatgttggtataaatcaaatttagtttgagtgttcattagtgtttctccaaagttcaggtagaaaatggggaaacactattacccttatcgggcactagtttccccgatgggtggtttaaaatctcaacagagatagtttttctaggttcatcaaaaccagtagaactgcctataatgcagtaactacagataatttgttaatcagtattgattcaagttaaacataatcctcatatcgaaaattactttggtaatacaaagttacattatttcagatccattaaagtaaacgttgaaagctattagcagcaataaagtgataacttttttccgcagcttctgtttccgtaatcattccctgctccagcaaaacatgggtgattccattgaaaaactgatgtaatagaaatgaaataaaacctgttgtttcaacttttactgggcgacaatgaaactgcatatcctgccaaagtttaatatcatcttttaactgttgagagctcacaatttcatatacaacagcagaaatattaactaaattaccgttgttattcagccaaattgtataacgattccaatctccttttctcattggctctatacaaatgtgaaataggtattggtaggctttattatttaaattgcggttatcccagatgtatttgagtaaatctaaatcgtgtttcataatgtttctccaaaagaaaaaagtggagaaacatcttacctatagggaaaatatttccccacagggtaaaaaacaatctcgataagcggtcaaattgaaataaaaaacctacaaatcaggcatgcaagtaggcaaaacgtgcggcattactacgagcagaagctatagcattactaataagctcttgtcgataaccactcaatgaatggtctgtcggcgaatagcttacgcctgtaatttcatcgctacctagttgaatgccactttccttatcagtaacggttgctacaaaatcagcatagcaaagtttcccttgtaggatttcctctatcattgcctcaaaatcgcagacatcaccacatagccaatcaacagactctgaataaaattcagaggatttacgtttaagttctatcagatagttttccgtgttaaatttgaaaatagtttccgtctgatacggtgaggcctcaataatctgatagccattcgattctaaggcacaggaagtatctttaatatactgacctaaatcttgaataaatccatcccacagggctttgtatttttccacttttgatgtagggaaataccactcttttcgggcatcacgatcatagaaaaatgccaaatcatctgctgttctaacagaaagctccatcgtattacaatgcgaatagcggtacccaaaactatttcgtatgatttcaaaatccacgccatagtgaggctcccaagattcaatgtgattcagcagattagaaaacattttttgtgtgcgtttctgaggatttagcttgttgaaaagattaattaacgtctccgtattaagcctaccgtagaatgctacgccatcgccttgacaatgagaaagtgaatactcaatgtttaagcaattaggaaaaccagctttaacaagagcgtgtttaaaataagtgtttaagactgagccagacattgcgcttctcctaaaattagagggaaacacattacccttttccggaaattgtgtttcccgaaagggtgaaagattgattaccacttatcgaagttaatcgctctgaatttataaacggatataggttgatcatagagttctgtttccgaaatccaattgtgttcaaccaagatttctctgacaagatacataaatgtactcatcaaatgacgactatgactaaacccgtttccaccaacataagcaaaccctctcagggttttgcgaattcctgctttaacaacaaggtaagtaatatcaacctcgccataagacgggcagacatcaaagcgagaaaaaacagaaaatgctttgccaaacttggtctcacgctctaatttcacactgaatagatcatgtgcatggcgtaaattccaaagtacactgtataagtgcaaatctgtttcggtatattgaatttttttacgagccataatgtttctcctaaaaaataaaagggaaacattacttccctctggggataatgcctccccttgtgaggtataagaataggatgtgaatatgaagttgcctatgctcgactaacaattagcttgccgttctgctcggacacactcagaaagcgaaaattaagtccttgccgagacggcatttgttgcataaatcgcacgcttttgatgtccttatctcgattttgccacgcttctaaagctctatgactaatttcttgctgtaaggcttgatgctctgatgtccattcattaagtttagttggtaaaacatctccaatacaggaaagtctaatatgaactaacatacatttctccagaataaggggaaatgcattccccttaagggaaacaacatttccccgatgggtgagttaaattagattaaagagagctgagtaccaaaaacggcagccataccacatacaaaggcaataatggcagccaacaaagtccagaaaaacatcttacgcttaatgcgggaaatttcctgttcatattcggctgcttgttcgtctaagcacatttgcagttctaaggctcgcatttcatcttcttcagcaatccgttgattgatgcctttggtgacttcaacatacttgcttttggctttatgtttcgctgaaacaaaaatattacctagcttgttgccaagtttccaaaaaagagaaggttttacggttttggatgattcaaacgggataacatcccatcctgcggtttgttgactcatagcgagttctcctaaaagttaagtgaataaaattcctcaggagatcgcaattccaagggaattgaaatatccctcggaaggtaggtgtgtaggtagcattcctgcaaatttgcagagttccctttcagaatgctgggagacattttgggtaaataactcaactacctctaaggatagccgccgcttttcaagagttatgcgacttttaagggctgtatctacagcgtcttaatgcttaatatcatacgaattcctccaataaaatcaaccgtttttttgttcaaaaaatatctcttttttgaaaagagtttttcctatcctcaacataaaaatctcgctaattttctgcttatttgttcgggaggagagcgtgatgaaagtaagtagatttctgggatattgcagtatagtaacaggtgtgttttcgccccttgcacaagcacaacccaatatcatcgtctataccacaaagatgtaccctattcaaaattcacaacttgcttcccagatttattatcttgaccaagtagagaattttgaagagtcaatcagtcgaaacctcagtaaatcaccagagattgccgaacaagaaatgcgtgcattctttaattcagcagattggaaagcccaagagcaacaattaaaagacgcttatcaaggcgtgatcagtggatggcaaaatggcattaagaaagtacctgcggtgttttttgataatccacaatcttctccgagtgtgatttatggtacgactgacgtacagaaagcattagatgaatggcataaatgggttaaacaacaaggtgaatcaaaatgaaaaaaacgtttcttacgatactgatctctgccagtttagctgtcccaacaaccttatatcctcaaccagccagagcctcattgaataccgcttccattgctgaatcaagtgcctcaacaagctgtttggaatataaagttgttggaacctgtttttggttattttgtacctactttggatgtaaggttcgcacatcaaccaaaattaagcattatttacctgaaatggttgtttcatcttataaccacgatgggcaaacgccatggacagaattacaagctctcaatcctggtgtaaaaggtggagaataccgttctccacaacgccaatactctcaactcactttcaaaaatgcggatgcgtttggacacccacaaggagctatcggtcaattattaggaaatacggggtactattgtaaaactcaaactacgccatttatgccttactttttgagtgggctggatttttttgcctggcgtgaaaatatgccggaaatgttttacccggaagctctgactccgggaatgcgggaagttggccgtgtaggcgatagctggggaaatatttacccacgttccggttgggtaacccaagcacacgattataaagcctctgcgaccattgtgcagagagtggcagacattgtgagccgaacagctcagccacacatttatttcccagcagccaaaacaggtggtgcaggagaatggcctccaggaccggtcgaagagggacaagcaagaacacataaatggcaaatactttaccctcaaatgtcaaatacctgctctgtttttcctaatggagggcaaacagatacctattcttctcaaatttcaaatcaaggtgattatgcttgggcattatggcgaccttatagttgttgcaaacgccgtgggcaaacattcctttacagtattgattggtcacactaataacattgggagcaataatgaaatctcactttaacttcaaaaaatcccacttacggatcacgacagcattattatcaagtgtatcaggactatcttatgccgattcgattacggataaactggaatttagtaagtcggattcgattatttcagaccgtgttttttaccaaatcggcggtggaatgggttatatggctccacctagtcgtggtaataccaaagttgttgatttaggaattggttggaaagcgaatttaacctgtggtaattttgatattaaaacgaccattaaaaatgatttaaacggtctcaaagacggctttaaagatttaatggggaatgtcattgattcagcgaaaggtgcggttgcaagtatgcctgcaatggtattgcaacgggccaaccctcaactctacgatttactcacaaatggtatgtaccaaggtaagctggatttcaaccgtcttaaaaccagttgtgaagaaatgtccaaagttttagcagatcatacactgggaggaaaatgggggcaagcagctgatttagaaagctataagcaaattacctcctctcaacctgatgcaaaacaagctcaaaaagacctggaagataaaaaagggaaagatgggcgagtttggataggaggtcagaaaaaaggtggggaaaaccaagaagctatcaatgttgttggcgatgttgtcaaagctgggtttaatttactgaacaaacgtaatgccttagataccagtacaatttcaggttcaagctgtgatgggaatctttgccaaacttgggataatccacaaacagcagccgattttttaactaagattattggtgaacaatctatttcgacttgtaaagaggattgtggcactaaaaccagctcaaaagccggtgtaggcttgagtccggaaattgaggaagaacatgttcgtactattgtcaaattagagaatgtactgaatatggatgtgcctaaggctgaattgttagctgatttgagttcaactactgtaccagtaacaagagggcttattgagagtcttcgagatgatcctgatgttgaggtattaagccaacgcttatctgcagaaattgcgactagtaagataatggaaaaaatgctcctggctcggcgagcagtcttagctggtatgcgtgagccaaatgtcgctcaaaatgcggatgcacaagtagaactggaaagagtactcaatattattgaccgtgaaatttcccaagtaaaactagaaatggatatgcaaaaaatgatcaccggcaatacggcttcggtgattttgcaaagcaaatccgaacgagaagctcttgctggtgctcatagtttatctcaagacagtctggataaacgtgttcaaggacttgaaaacggtaatgttgcattaactgatttagaggcaggctctaatattaacctctctcgtagaaatattgcattgagtatcccgaatattccgaatgtagctgctctcatacctaatctgccaaatcgaggtggttcaggtgtaggtggaaatttcccatcactcgcacaaatcagcggttcaacgatggatcaagcaacaggattactacgtaattttgaaggctttatctctaaggctcaatgggatgtaaatgctcatcgagtaggatatggttccgatacaattacccgagctgatggtacgatcgtaaaagtaaccaaagatacggtcattaccaaagaagatgcagagcgtgatttggcccgccgaacagctatcttcgcaaataatgtgagaaaagagcttggagattcaaattggaatgcgttaccgccgaacgctcaagctgttttagtgtcttatgcatataattatggttcacttgctaaaacaaaaagcgtacttgatgcagccagaagatcagctcaaagtggtgatatgaatgctttagctactgcaatcagaaatcgccaagttgataataatggcatcaatgcacgtcgccggaatcaggaagctgactatattcttggtaaaaattaacctcataaggagttacatttatgcgtaaattattaggtattactgtacttacactttgtacaacttcagcatttgcaacggataaaaatgtggtattttcttgtaccagcacagaaggtaaacctctcacagttaaacgggtaggaaatgattacgagtattcgtatgataaaactatcttcaaaaacccaatcaaaaaagcggtgaccaacgatggctcaattatcgctagaggatcaggttttaccacgtatgcattagaactgaaaaatgatggtttgaagtatgtagttgggtttgttcaaccaaatggtaactcaaaagagtttattgagcctggagcaacgattagccgtgataatgatcaaccaagcattggctctgtagattgtgatccttacaaaaaaatctattataagtttgatgttcatttaatgaataccttgtaatgcgataattcaataatatgggggaatggcttgatttttcatcccccatactctattatatagatgtggtgctagagccagcccacgttaaaaaatacaaagctcggtagatgaactattgtggtgccagagccggcccacgttaaaaaatacaaagctcggtagatgaggccccttaagtcgtaagatttaaggggttttgcttaggatataaaatggatattacaacacaaaatattgaacttagatacttatctgagcagttttaccttgatgtcgctccacatctgaaagaaattttgcttaaagagactcgcccatactgtgttctattagttagagttaaaaatttagattttgccctaccattgcgttctaatttacctgaaagagaaggagttggaattaaaacgatacctaatcctcaggaatacggcaaatttaaaggaattgatttctcaaaagccattctactgacagataaaagctatttaaaaacagataccgttcagctcaaaaacaaatcagaattgttgaatatccaaggtaatgagcgtagaattgttcgtgaatttaagaaatatgtgagtgaatatatcactgcacataaaaacggttataaattagatcataaatttgaatatacaactttaattaattatcatactgagctgaaaatcagctaattagaataattggaggagctatgaaatttatcgatttcggaaagcagctcgctaacccagttaaatttatcaaacagaatactgcatttttacctaagcctattcaacaagtggtcgtttttgcggtaatttttgcaggattgcctctatttatcttgggtttctttattctcagaatatgggcttataagcatatttctttgtatagtgaatataaagatatggctaattcagaaatatcgtctaaagatacagatttaaaatcacttttttctgatgatgaagaacaagaagatgatgaatatcaatatgggtatgatggaccaggtatatatctaggtaattaccgtgttgatgagtaaaagtaaatagagtggtatataccactctattattcagttgttagattatttccctatcttggaacccgctgttttagagtctctagaaccagtagttaaatgacttgcaaactctcccatttttactcctacccaagacatactgcctagccaaatcgctggtaagaccaagaacatagaacccatcacaaaattcacaataatatcgtcttgtgtattttcaaggaaataagggtttattctgctatgtgtgcctgaatcatagaggaccgacagcaaccaagagtcaagccatctagctagttcccaccaaaatgtgagtgtaactaatgcgaaattcacaaaagttagcgtaaccaatgtttttaacgaataaccactcataaccataattaaaggcgtgagaataatcaatgccattaatgcaaatgaatgcaccatcggtaatgcttgccgcatcgaatcaaaagcagggaatgctccgatactgcctaatgacagaccaaacattgaagctgttttagtcacttcatttgtaaatgatctgtctaaatttcccccatacccgggataaactttccctctcgaaatatccatattctcagctcgtaatacggtacgaagtatggattcatcggaattttctttactgctgaaaaaatcaatcacttttgcagagaagttctgttttacatcatctaataaacgatcttttaaaccattattcgccgtatcccaccactctgcacaatttggaaaaccaccctctccattattcggcaatccattatcccgagaagcattatagggaaatagactatgaggttgttgggctcgataacggggataaagctcgctatttgcaatcaaaatacggccacctaaccagctagtctcacgaacctgtgctgggctcaatgaaagttggctattttgaattttctgacgtgccggtacatagcattgttgtacaaataagcgaacctctgtcaataatgctggattattgattttctcgtgttgaacttcaaaacgaacttgacgtaaatccggtttgcagggaattgaagctgttaaggcgtgtgttacccctttgttgatttgatgaaataatccccaccagatagggactctcgcttgttgatcacccaattcagagttcatttggttataaccactatcctctggtgcagttggaacacgataaccacaggctttagaacgttctacattcaactcaatattattcaggttgatcggtatcattggagctaagaccaatacaacgacaaacatcgccgggtaaaatttgaggctgagccaagtaataagtaaatcccctttattaccttcgtcctcaccttgttttttgacttccatccacgtactgattaagacaaaaatgagaggcagaacaaacaaccctgtttgaaccaatacagcgaaaatattgttgttgatgatccaagccagtaaggtaagaaagtattctaagtaactatctacggtaaaggtcatctcatcctccttaaagtagatacagtaaattaagtccctcaataattgggatgacagataaaatcattaacctggcttttaatggcatttgcccttttcgattaagttgtaccatcaatagccaaatagctacatataaaacaaatcgccatcccaaccaggcatagcgggtttcatagaaccacgcttgaaaatttgtggaaggaaaataggtcattgccaaccagccaacaacgagtagtaataaaataataccgatgatcatcaaggttatttttaatacagtaataacccttgtcattttaggctttgttgtatcagacttcattattatctattacctcgttatacacagagttatccgcaattgatgtggataagggtaaaagattacttttcaaaccgagatactgagtaaggaatgccgaaaaccaataagcatccacatgatcagctatttcaataattaaacgagctgaccattcactgttattggaagttggtagcaaagaacgccccgtcacattaagtaataagtgaacagaaccctgctcaccagaaagttcgatagcccagtgattttgcacgacacgatgagggaataaggtaatctgtttcccaacgccgatgagttggcgaatttgttcacaaaatccaagcaattgagtttctaccgctggagatacaactcctaatgaggatttttgtgggcctgcattaaataaacggtaatgttgtttattcattagtgtattcctcttgctttatcaatccgagctgcaacctctaaagctgcatcgagttcggtatagccgtgctgcatcatcagttgcttacgttctgctttttcatgtttttcagtcattcctaaagctaaaaataagctaggcggtacaactcggaatagagcttccatattcgttgctaataccacgccctcggtatatttacgatctgattttttggcagataacaacatcgttttctgggcctctgacagtttccggaaacgattgatttcatcaatttcactggcagacacattcaacaattcccaccattcgaccattgagagtaatttcgccgcttcattcgggaagtcatccatattttgagtagcaagccatagccaaatccctagtttacgccacatttttgagcctttaactaggaatttagctaataatgggttggccgtgataatgtgtgattcatctgttacattcagaatcatccgatcactgtgttggtatttttcaccaagactgttgatatggttaatgagtgaaatataggaaatggccaactctgcttcatagccttcccgggcaaacatagctaaatcaactaaggttagatcagcctccggccaaattgccccctctcgattaaaaaattgcccatttacaccggtacaaaacatttctaatgattctgccatttctgctaaacgggtacgccgttcttcacgagtatgctcatcatgacttaatgcttccaaagcatttttaatatcttcagtcagcgtttgtctgccttcagatttggtttggcgagctgcatttaaaatggcacgacgaatagcagcacgatcagcacggctcattttttcatcttctttcttttcacctccggtgatcatcaaacgtgccgtcagctccatttcggccaataaatctcgttgcatatcaccttcatcatcagtgtcatcgttatcctcaatgtcttccggcacatcttccgggtttaattccatatccaatagacgatgtgcttctgaaaagagtggtaagacaatgccgctgtttggagctaacgtaatgcgatttacagtcagtccgaaacgttctgcatagtccgctaataaaccaaatgaatttcctgcctcaacaacaaaagtccgtgggcgataaacggccatagcctgacataattgcccacataacgtagctgattttcccgaaccggttggacctaataatagcttgtgagcatttttggttctgtctttacggttaaatgggtcgaaattaaatggtgctcctcctcgattaaagtaagtgatccccggattcccagtcccggtatctcggccaaagataggtaataagtttgccaaatgttgtacaaaatagtacttcgtgtagtaatgtgatttggcatccatctgcggattaaaattcattggtagccaacgcaaatagctgttaagtggggcaatttctgcattttccttcacgggttctaggttgttactgagcagaatcgttctcaactggcgagaacgggtacgtagctccttttcatccttacctcgaacgtaaaatgcaatagctgcttgatagagtttatgcccctctttaagataagactgtacagtttgacagtcttcttttaggtatttcgactcaaaattttcacctaccgctcgactactaattttttctaaatgtgcctccaacttatcctgtggatggatgacgatggtaattgccataatggttgattccggcaacaagtcaaataatgcattgatattacgcccacgagtaatctcgccagtcatcaaccccacttccggttgtttcctcaaattattgactacaacaacttcgtgcggttggtcatcaaaataccaatagttgccttcatttttcggttgagaataaaataaatcttcactgaaatcgttaaacgctaattctggaagcccgtcatttgaggtttgtttaccaaaaagatggtagcaatcattgttgcttaacccctcaaaattaatagaaggattgggattaaaccaacgtaacagccattgacgaaattgttcgccatccagtcgctgcaattgtaatccagcagttgttagagctccatttatgcgagaacaagcattgttcagctgctcgacaatcagattttcattagtgtcattggatttatcaacataccgatagatcaccattttggtactacgtatacgaccagaccaagctgtatttgtcactcgctcatcaataaaaagcccctctggtttaccgatatccttgaaatgcttggcttgtacccgtaaccattcttcgctaaatgcactatttttagcgataggcgagatataatttcgtagctgttcaatataaggctgtaaatcatcgctgtcttggcaataaaattgaacaacgtacggatttacatccaattcatcaaagctgtcttgcaaggcatctttgacaagattacgtatccgacttaaaaattcaatactacggccagcagtaccaatcggcttaatatcaaatactgccccaacactacgggcatcatcaaggagtatcacaccgtgctcattcaaatattctccccaaggtagatgatcgataaaggagggctcttgtgagtataaccgacggtgatgctgtgactgggtgagttttccactgcgttttaattgttgaacctcgttatttacctcactcattttattttgaatgatgtcagactcaccggtattttcatttggttcacttgatataacccctgctttagtcggtttgaaagaggaaaatacctcacttaaaaaagacatgattaaagccctcttgttctatcacccggctgagcatattgaactcgtccatagaaaggtagtactgtagaatatcctggaatactgagaggctctccggaacgagtttgatgtgggtacacatacataatcagatccggattaggtaaacgagggaacaagttattaatttcattttctgccgtacgggtataggctcgttgctcactattaggaatataatcgacagggtcaagtgttcgcccttgttgtgaacggtataagtgtagatcgttattactcgctcctttatcccaaatatcccgcatcgtactgccgttagtaggtaataattcttctgttgatgttgtgcaacctgttatcaataaggcacttatcattatgcaaaataaatgtttcatcgtttgttccttctaatccagttgtgaattcgttgattttgagccatatttcactttacgaccttgggcgttgtaatcgatttcaatctctttctcgatatgaatagagacacgatgacccggtggcacatatacagcatcaaagttttcagcaaaacgttttctaaaccagtcagcagattcttttaagccgcctccgatagcttgtcctaagatgaacttaccctgatcgccggtaacagctccaacaacactacttccatcaacaacagtggttgtttgtgactgtgagaatccttgggcagcagcacttgcagcagccaaaaagaaattcgttcccaaatattctggggcattggttttccgctctcctggaacacaagggatacccgaactatctgataaccagccaatctcttcgccattccctttattagaggtactcacaatacgtccatcattgaacacaaaagtcatactttttacactgcctctaacacaggatagtgtccagtcgccagtagcagtacctgatacaattgctccgtctacatcaggtaattcaataccattagcaatgagattttctcgaccaataagtactttgaacggataagcatccgatactcgattatcaatcgggatacgtccgatgagtcccgtcattgcaactgaatcaaggaatgttgaattacttggtatggtatatactgatgtcatctggtttttaccacgtgcgtttccagccgttccttgtgagcttgtcacagtatctgtttccgggaaaaacggcagacctttcttttcgttatttcctgcagattgtcctccattaaaatctttcggaaagccaaatttagttgctactgtattgcctgacacaggttttccacttgcatccaaactaatctgatcgcttggttctacccaatacattccactggtatccacgttggacatagttgcaccaccgataggtaatttatctcctgctgttccaaatcctttattcggtaccgtattaggctgagcctctacctgaggggtagactcttgtgttgttggtttgttattaacgagagtcgccatatcaaataattgcattttcaaatctgcaatctgctcttgcagttttcgggtttcattatttaccgcatcattgatacgaccattcactaaatcttctttctgtttgagttggcgattttcatcaattaactcatccatacgacgctcattggatttaacggttgtcacaagggtacgcagcgtatcaatcggcgtatcaccttgaatacccattgttctgacttgttcaggtgttaaatctttaatggaaatatctaaaatttcctgttgtgtcggttgtggaactgactcactacgtccaaataaggcatagacaattccaccgactaagataaatacaatgcccagtatgacaaataaggctttattcgctttcattgcctttcctcctacttcgccgattgagccggtttagtttcaacttttgttgttcttttcacttttttactgactagtttgactggacgggtttccggaattaatgcgttattagcatagccttcggtcactaaatacagggttgtggtatcttcattttctccgtaccccccaagccaattatgctggaaagtcgctgcataaaattgtccttgaagctctcgagggtcaagcgtaatttgagtgttacccttattttgcaaacgaatagcggtaactacatattcgtctaactgccagctaattaaaggtgttgcttctattgaataagccggtagcagcttggtaatttttttaggtagacgatgtgccacacgacgcacaccatctaaaggttcaactgtacgtagtggagcataaagtgattgtgctgcataacgggtcaatgcggcaggtactggaagctgaggacggctattcgcaataggcagatcagagctttcatcatctctattgcttgaaaaagattgtttttctaccgtaccgtcaaaaaccactcgaattgcctcttcaggattagcgactttcgaagctgctgttaaatcaaatagaaaaatttcaccggttgtaacatcacggaattctatgcgagtggagggaaatgtttctaatgcttttaaatagacggctccaccggtagattgaattcgtagcttaccgtccagttctgccggataaccaaccttgacatttttatcgacaaaaataattcgttctttttccacttgtaacgcaacaggaagtggttttctttcccatttcatcaatacatcagccaagctactcccagagaagcctataagcaaagagacgagcaaaattggtagacgtttcattattttttctcctctgtttttggctcaacaccttctaagagttttggaatggagtgatagcaattaaaccctaatccccaagggttttgagcagaatcgacatccattctcacaatactgataggaaaacgaatataaactcgttttaccggctgtccttggaaatgttcatccacacttaaatcaagattgacagcccaactatcttcactgaatatggtaactttatcttcactatatcctctaccggtaatttcatacaccatacgggttcggctgcgtagttcattgttacgcagacgatctttataatcttgtcgtaaaaatgcttcacagtgtggtgttaaaaatggtttgagggtggtgatatttttctcataatcctcttcgccatttgtcatccaccgattcatttgctggaaaatttgataggagaatgcataaattgttggtttaggaatttcccaccaagctcgttggctcccagcacgcagatctggtgggttgtatatcgtaaggcgacttgggaaagtatagattacgcctgccagtaccaaaataataatgaaaaacaggaaggcaaaaattcgagtcgttttgatatgtttatctttttcgtgtaattggctttttaactggctcatttgttatttccttctatatcggcgaatagaccaaaacccttctcgttttataaacttatgaccgttaaagaggtcatccattttcttttcaactaatctatttaaataagcctctggttttcctcgtttaaccgcagcgacaataccttttccgattaagacagttgcgatgcagagcaacattgccattgccggaataagaagccaaaaatcagttaatatccacaagaagagaccaacaatcagacctaacataaatcctaatccggcagatatgccgaactcactaactgtcatcccaccgtaaacggtagcttcacgattaaggcgggtgggaagaaaaggaatggttgtatcttgttctgacatattggtctcctagacattttaattagaagagtccgactgcaagtttgactaaccacaagcagaagaaaatcacaataaagccgataattaaggcgagaataaagtgtccccaaccttttttaccattttcagatgtagcttcgttatagatgccaatcaatgctttaacaactgtcaaaatggctacggctgctaaaataacagctccgagagtgacaagacctttcagaacaatccaaataatttccattggatctttggtattactatccacgcctggaatttggaagtctgggattttggaagcatcaggaccggctgcaaatgcattttggagggaaccccagaagaagagcattacagccaaataacgactatgcagatgtttcgtaagagatttaatgcggttcataatagacctcgaatctaatagataaagaaataagtaacacaagctaacagtgccactcctttgagaaataaaactaaaagtgaaaaaggacttttatctctaaatgaaaatcccttataaccactattcaatgcccaagcgacggctaagagcagtaatgaaagaaaaataatggcgatcatgattttcaatctaaaagggtcgataccgctggcaacagaaaacgcattcgcaggggagtaagacatcactgcccccgtaatttgctataatcatcacttaatgtacgtagtacattcggatcacgaggtaatgctcggcttggattgatatattgttgaattccttttttgacggtttcaatatcactgtgaatagcagaatagttaaagtattctcgtgttttaggcgaggctttagctactttttctgctcgttgaagtgataattttgccgcttccagttgcttaattgcctgggctaattgctcttgttctgttgaagcaagtgctggcaagcaagataaggtaacaaggacaacaatacctttccttaaagatgttgaaatagacatagtgcacctctatttttagttttacttcaggttaagagtgccaaaagcgatcctaaaatttaatggaaaactctgttaccgttcagaagagaaattgcacaaaatagtaaatggtgagaaagatattattctatgtttaagctagtcaattaagtagtatcaacaccgaaatcttcacgctttacgatgagataccagatgagatatctagcactgttccttgtagttttcccatatgttgcccattctcttccttcagcacagaaagtggggaatatttgccatgcagaaaatgctcaatataattacggaggtctttgggaattaagtttaagaggaaagttaatctgtaattattggcaatttctaggcgatgatgagcgaaaaaagatagagttacaattggatgagtacggggaatttcctatttggaatacctctgaacaaatttctgaacaaatcattgaagatgatgaatatccacaatattgggaagtcgaagactgggaggattctgattgggatactgagtcagaaaatgaagatacagaggcaacaacagaagaataagcccccgcatattgctaagggcttatgaaatttacaagaatttcttgaaactcgccgcagttatacagatggataaaccaaacaaacaggctgctgggactaaaatgatgttcggatgaattgaaaacgggatagataaataaagcacccaagctgtgaccatcattggcataatataacgtctagcgtgatggtataggtaggctgattcccgcccggcaccaaattttcgtatatctcgtaatgacagtccttcggttaaaccggaaagtgcagtcaataaaaagagtgggctggtaaaaacaataataatgaggcgaataataaaggtgatcaccacataaataacagattcaatataggctctgccgtagtgatgtacccactgttccatactaccattacccggtgaagttaaccactccttaacacccgtataaacgaataaccagttatacacgttttcaataattgatgttgcaaaagcagtagaagacttggcaaacaggctttgagaaaagtcatccgatagccattgcatctcattgagcatcatcgtttggctatgcaaatgcccttcttgcggccaccagaaagcaatgcctatccactctaaaataatgctgaatatgagagatactgcaattgcagcaagcgacatatttatttttccaaaaatcaggttgattaaacctgattttcggcgagctttagtttcttcactcattgcaaactatcctctctatcgagctggcactggacaaggatatagccggaaggattattatcaaaagcaagataaaaagcgaaaatatctttggatttatccgagtgacgcatagatacttcatcggcagaccataacgaaagcccttgatctgcgaatttttcggcaaactgatggaaggaataaccttgttcaaaccattcaataaaataggattgactatgaatcaggagttcttctgcattatctaagccacaggaagctgaaaactccccattaaaattacggtatttatttggtaaatctaatagattggttcttttttcctctctcattttggcactactcatcattttcctcttcatcaatatcgtaaggttcatctatgccgaaattatctacttgatggtctatctgtgttttatattgaggctccgacatcgcttcaaatgcttctgcaatgtctcgggacggcgtatattctgtaaatgccggttgccaccaattttcaacaacgtgatagtttttacgcatataatctgtcagctctcgtaaagattgatgcatcatatcatctttatcgacagcaggtaacggcattcgaattttccataatttactaccgtccattaaagcgaatgcttgtccttttggtaaattggtaatgttggccggaaccaacataggaacggtactttcgctgatacgctgtccggtattggagctaaacgccttatcatcgtcaggattactggagtcagttgtactggacgtgaccgtgctacgtttaatcgtcacttcgtgtaactgttttgtgagtaattctgccgtagccggttcttttaccctcagcatatagagtgtattgaagttacctaaggtttgtcccgctttcggtttactgccgatacgagcttcaatgtcggagagtgtttgtgtataagcagttacttgtattccagcaccaccgcctttgttgatgagagggataaattcatcacccatcaattcattaaattcatcacaatgaagattaattttcactggtttggatttttctttgaatgctcccggtaatccgtcatttgtcccaaatttatataaatgacctgccattgagactaagtcagcaaacatactgtttcctacagcggccgcaactgtcgcatcagagagagcatctaaaccaatataaacgattcctcgtttacgaataatggattcccagtcaaaaatcggacgttcatccaaaatatcagcataatccggggataacagctcagaaattttccctgtcgttaatttttccaataacggcaacaatgaggcaacaattttatcgaaataggtacggtcatagcgtacagcactggcaagtccttgtagaattgggtcaaagactgcactttcagcaatgtacttgttgatcacaaaaatcagcggacggtctttcattccgaaaggaagtgctttttcatccagtccagcggcgatggttgctaaattttcccaaatttttggatcggttttacgaatgaatttttccgcataatcaaggaataatgaatcaatattttgtacaaactgggaaatttgaacatagtttgggcgatttcccaattcaactaatgcacgtgcgacgatattgacaaatcgccaagcgaactctttaaatgccgccgagttacccgctccacttagctgtcctgaaatacgcccagcgacttccgaaatacgattaaagcgtcctactgggttataacgggcagaaatttcgggataacctagatggaaaacataaaactcatcttctcgccccgctcgttttgcctccgcatacattcgtttgagcatatcggcatcgcctttcggatcaaagaagactaccacttcacgctcatcagcagttttacctcggtggatatcctgggtaacaaagacctcagctaaacgagttttaccgacacgtgttgtaccgaatactaccgtatgcccaacccgagagctaacggattgaacgacatcaacctcatccggctcaattccatggatagcaggaataccctcaacaggtggcagaggtctaaccagattccaccggctatcctttgaggtaagatgtgttagccaattttcgtgtcgtttttcatactcacgagccattttaaatagcttagaaggctccagatattttgaaccgttatccgaaaaacaatcgtgtaaccgttgagtgtgaataggtttccattcaaatcccttaccgacaaacagatacttattactgaccggaatttgcttgcttgtcattgaataattaggcaaacgtttcaggttgcgatggtaacgcacaatttgccaaccttgttttgcccgataaaagctcaatgctccaaaaccagctgcaatactgtaaccgatacttggatggagtgccaaagaccaaggagctgcagcactgacaaaggcacaagaagcgtgaaccgctgccggaaaaaattcaacaggaggtcgtaaccacgcctctaaggtatgtttagcagacattattgtgaaactccgctttcagtgattaagacagggtaatgtgcaataccaattcgctctgcaaggtcatctccgggagttggtaatattctcagttccggtacaatgtctcgtaattgattaagttcggagagtgtttgtacattcactacaagccctgttgcattcaacgtgatcaacttctctcgattttgttgtaaccactgagctgaggtattatctgctccaattaagaaaatggcttgcattccggttaaatcaaatggtttttctttaatagtcccgggagatagtttatgggaaacaatgggtaaaatatcagcctcactcactgaggctgaaatggaattcggatagtttggtgcattttcatcgtgttccggttgcaaagattcataaaaacgtaccgcactttcaccaccgaaatcagcaatcacggttaaatcagcccaagagaaatgggacacatataaactaaacaataatacttttaccttgttttgcatttttacctctgaagagtattttggggttctacccaaaccattgcatttttaggttcaacccaaatcattttattatccggctcaacccatttgaccgattttcccatttggcttgtgggataaacgaaagctgcaactccggtatgaatatgcccttgcttggagacagtcataaaattggcttcttgcttatgtgctaaaaaacgtcctttttggtaattgagaaagtctcttaccgtcatccaacttttcattccattacgacgcatatttaaaatgtcttctttagtagctttccccatcattgctcgatgcagcccatctaagccgatattatgagccatatataaattctcatcagtaatagggatattacggagttgaaattgctcaatatgccaacgtgccaataatgccgttgctaaggtattcgtatatttatctcgacggggatcggcgtaagaaccccgatttttggctgtaatcaacttcataccaagttgctttcccctctctgtttcagatagccagttccaggttcccatagtaaactgcccaacaccggttgctcctgttggtgaaatgttgccataccagccatcttccattttgacaaaacctcgtagcattgcttcactcacctgataacgttgagcagccatacgaatatagctgtcaatttcagaaccaaatccattgaagggctttgcctgagaaatgctaatgttggaaagaaagactgcaacaatgactaatacacgagtgatgtccattcaccatcctgtttgatttggtaagcagcgggcatttttcctaacgaatatctcagccaatagcctttatcgtggttaagggtaatcaatcttttactgacttttattgggtcaatattattgtcggcagcccatttacgaatatcattatcggagatgttttgcccaacaatataaatatcgagaggtgtttgattatttgcgtaagagaggattttcccaagatcacttttacaagaatcgcagttatcaaaacgggtaaaataaaccacacgacctaccgattgagaaatatgtggttcaacctcaaaaggtagctcattcggataaagtttctcaaactcctgacgataaactttgtcaaaatcaagttcttttgacactcgttcataatattttttcgccaacatacgagcatatttttccctttcctcagcagttcgtgcttcgatacctaaagcagttaacggatctagatttggcgaccacatacctcgctcacctttcattaattcggtataacgactccattcttcaacggtcaatccccattctttagcctgttttaggctatcacttaattgtgattgttgatgttggctttgtttctgcaaagtcgattgtgagctacttacggtctctgtttgcatattttgagccagagtaggtaatgcaaaggacaataaaagaggtagtactgccaacggtatagctttacggcataaattaaacttcattgatatttccctcattattcctcaatgacctcggttttaattgttgtcgttgtaacggcaacagcaggtttatgagggttttggaatgaactttcccgagctttaaagcaaatcgtacgggatatatcattaagagttagttcataagcgggacctgcaatcatttgtagagcttcatataatttcatcggaccgaattggtaatgaacttttggaagaggtcgggtaaaaagtgtttgaaccgcattaccttgttctccgataggtggataacacaaatctaaacccgtattagttaatgtagaacgcaaaccttgctggacattcgcagtaaaacgatttttaggattggagactttgactgatacgacttgttcaagcagatatttttgaccttcctccggagcaatactgattaaggtgtagcgtccgtcacgtaccacttcggtattcgaggtagtctgttcttggtaaatatctttggacacgatacggtcttgtggaggtaattgttgcatttgaggtgttagcaatgaatcaggcataggtgtgatttcatcactattttgagctgtatcctgttgatgaacacaaccacttaagccaagcataaaaacagtcattaaggatatttttgttttcatttaatctctccaagtatgaaaggaatctagaccaactatggcgaagtcattgctgattttgaatgatttattctgttgttgattgagagaataaaaaaacgccatcattagacggcgtttgaaaacacaataatgtgctgtgttaatcggatttctccttagtattcataagaaaataagattgttgtacagctacgatcagcttctgtgatgatataaagactttcatcatctacatcgtagcgagctacaattctccctccgtatttcattgcttcctgattcgctaatttatcttcctcacacaaattgccccaatcaccataacagtaacgattaagcaattcaaccaaggcattttgattgaaacattcagcaacagcacgagttgtacatactcgaccaagttcaaacgtcatacatttctcctaaataaaatacggggaaatgtcacccattaggggagtatttccccaagtgggtggactaagactgcggcaagagtcgtttttagtaaaaatttgcaaaaaattaggcagctaatttagccggcgtcatttctttacgaatcttgtctaacatttcattccaatcatctatatcacagattctttggcgattaatgtaaaaatgcgtgtctattgcattgatatagtagtcaaattcaactaaatctgaatcttgctcaatatctaattcagtacagaatcgttgaattaagcgagagatgacaagctcctgatacagattaccgaaatgtggtacagtttcaaattctttggcaacaagccaaaagtcttcaatactgacaatatcgctatattcttctaagatggcttcccattgtcctaaatagcaagagatatcatcaaagtcaaaaaaggaatcttccattatgtttctccaagttttaaataaaaagtggggaaacatacctaccgagaatgtttcccgatagggtgtatagtcaatattagcgataaatatcaccgctcactgtgttaattttacctaaaatagatttacaatgaatgtcagcactcacagttttcacattcgaggttacattaccatccactgtgacatcaccactgacagttgaaacagatttggcatcgcctgttacacgaacattttctgaacctgcattgaggttggttacattgccaaatacttcaatgttgatagtcggagagggttctaatgcaattgtttgtccatcaacaattaatacattattgccggcagccattgagatataacctttatttatcccaacaactgtttgcactgtactattaatgatttgaacgctgttgatctctttgcctttagagtcaaagacttgtttaccgttgatataaataccttgtcgattcatataataatcctctttgtattagatgttaaaatgctcgatagaatacgatattaccattggaaatttcgttgcgagcagcctgtacaaacgtagttaattttgctaaagcaggtgtattagtttgctctaatcctactcgctctaacatatctagatcttctatgttcaataccaccgtagcatctttccagaatgtctcaataggttgatagtattccggttccgatgaggctttaatttcttttttgaagaaatgaaaagccatctcgttgtgaactaagaaaatccctctatcatcggcttcagtccaacggaaaaactccttggaatgttcaattaactgaatatctgtaccataaatggggttatcccaatcagacacaatgttatattcacgctctaagcctaacgaattaaaacgttcaagagagattgaatacgctctagcaagccaagaacgttgagcccaagatttttcagggattacctgtgccggattttttccgaaccaatagcaatcccaatctaggtaaatccaatccttttcctctatgcttttgtcaaaaccaataatagtaaagccttgatcaagccatttaccatagccgttctgaacaaagacaacatcgccaacaataccatcaaaatggcgaccattaaggactgttggtgataatgttttgacaaattgttgaagtgagttcatcgtgtttctcctaaaattgtaaaataaaggaaaacacaccgcagggagtgtttccctacgggacataaagtaaagcccaacataaattgtcgggcttgggtaaaattactcagattgctcatctgcttttggtttttcttgatagacgatttccccatcaattttaatcattttgatrykgatyaagcgacctttaagagacactccwgtatcgccttttttgtgatatttactgtcacttgaataagtgaaagtatcgaaccacaaatcagccattacaaatgatacaagcacttttttctcttcagagaccgctttttggcattttttgatgagtgtttcggtttctttaccgactacattcatatcaaaatatctgtactctggtgagtcagattcgccaacaagagctgcaacacgacaagcataaaaaggatttccttttttatgctctactaaacgaatatcgtttaaatagccaatgccggtagtatgtagattgaagtaatttttttgagtagaagtttgagttgtcatagtttgtttctccaaatgtaaaaaagcggagaaacatccttacccaayacgggaaaaatgttycccgcaaggtggaagtaaaatggaatctcaatgaatattcactgaaatgatagggattgagttggcattcctgcaaatttacagagttccctttcagaatgctgggagacattttggcaataactcaactacctctaaggatagccgtcgcttctcaggagttatgcgacttattaagtgctgttatatacagcgtcttaaattgaggataatttagccatattgaatcataaagttaattgagaattgaattttgattttagagaattggaaatgacaacaccgttgataaatcacttaccaacggtgttgtacttttgaagaataaatgaaatttaagttagaccaatataagttactatattgaaaatagcagcaccttcgtgacaatgttgatattttcgttcgtaatttacccgattaccttgtggtctttaatcggcatatctgtggcatcatcgaggacacaaacggcaccctttattcacctgtgggctcaggctcagaatagttagcagtaattgcaacgtcataatccccccaatcgggtaatattatgacgttgcaatcacgatttagacaattacaacagactaatgtggctggcattatccatttaatgtttagttggcattcccacaaagtggagttccctctcagaatgctgggagacattttggctggtgtagattgataaccgacaatctacaaaacgggttctttgttccttgataataccataatctacttgaatttataactggcttcttaatttattcagttgatcgagtacatttaaattactacttttcttagcagatttatttgaagctgattttacctttttatcagcctctttatgttggcaatctggataaccagtacatccccagaatgttcccttagcgtgattgatttttctcattggcttaccacattctgaacattttcggatttcaatattcccaagtgacattccctgttgcatacaactgccgataagttgttttacaaatgcttcttgcttttgcataaatgcatcaagtgtcatactaccttcggcaatctgattgagggcttgttcccataatgccgttaaaccgggatttttcagtaagtccggcaaactatcaattaaggcaacggcttctgctgaggcaaccagtgattttttcttcttaaggagaaatcctttgtcaattaggccttgaattaatccggcacgggttgcttctgtgcctaaaccttccgtttcacgtaagcgttgtttgagtcttgggtcagtcacaaagcgagcggcatttttcattgcatcgagtaatgtcccctctgtatagtgtgcgggaggtttagtttgcaatgttcggacttcagaatgagtgacattgcattgctgatttttagtcaatacaggtaatccttgtttctcatcatcattaccagtttcctcatccacatttttgccaaacaagatacgccagccttgagcaacgatgacatttccccgagcaaccagagtgtgcccactagattgcagagtggcaacggttttatccatttccaagtgcggtaagaattgagcaagatatcggcggcgaatgagatcatagaccttcatttcctcctcactcaatttacttaaatcagcttttttaatggttgggataataccgtggtgagcggtaatttttttatcgtcccacgcccgacttttttgtcgcaaatttaatttaggcaagagagtttgtagccctgaatcagaggcaactaatgagcggattacgttaggaacatcagaaaattgtgattctggcagataaccacagtctgtacggggataagtcgtgattttatgctcttcgtaaagggattgtgcgatatccaacacctgctgagccccaaagccaaacaagcggttacattcgccttgtaaatcacttaatgcgtagagtaacggtggagattttttctctcgtttagtttcaaccgtcaccactttggctaagcctgtttgtttaatttgagcttcggcttgttgtatgacacgactatcaaggcaaagtccggactcatccaaatactgttcaggtactgcaagcccggcaacgaaagtttcaccagaggttgttgtcagctgaaccgctaacgcataatgagatttaggcacgaaattagcaatttctctatctcgattaaccacaagagttaatgttggactttgtactcgaccaacgctcaatggcttaccggaatagccttttgcttgagccattaaggtaaataaacgggagaagttcattccaatcaaccagtccgagcggctacgtcccataccggcgtagtaaagagcctcggtttctttacctgatttgagtgtttgaagagcctttcgaatactggcatcatccagagctgatagccagcaacgttggatttgacctcggtatccagctaaatctaacagctcacgagcaatcatctcaccttctcgatcagcatcggtcgcaatgaccacggaggttgcttttttgataagccctattacaacagaatattgcttcttagactcttttttcggtgtcattttccactgagcaggaataatgggtaatgtttcaaatgcccagcgtttccacgcttcatcataatcttccggctgatattgctcaacgagatgcccgaacccccaagtgacaataatagatttatccgcagtcgccagcaagccttcaccttttgaagtagcacccaatacgccggcaagatctcgagcttgagatggcttttcacaaataaataatttcatattatttcctaaaatgaatacagataggcaaatagtaatgtgctgattaaatagcattcaacgacttattgtctcgtaggatgtaataatttgagaaataaggacataaaaaatcccagtgtttccactgggaagaggttctaggagcaatatgagttattattttaatgtattaagtaaacgctgttttgcactatcgagccatctagcactaccagttgctttccattcaacattcacctgatttttactgcctttttcaatgataacttccaagtagttttcacctaagtgtaccccatcagtatctacatcagattcaaaatagccggaaacatggtaaaaagtaccttgtaccgtatgataaactttacgggagtcactatcagcattcgttgggcggaagccaaattcccgacgaactttcaggaatacatcatcaatattccgcttcaactgcaatgtgccggaatcttgataaacgtacttaccatttcgggttttagtataaacttgtcgcccattatgctgttcaacagagccgtctttagagccatagagcgtctgattcatttgcccggcccaatccccaaccttatcgttaattgctgagagttcagcacagcctgaaattagcattgtagaaacaagaaataaactatatttgatgtaacgcatagaattctccttacaagcgggttatctgcgttcattttttgcaaaagtgcggttaaaatctacttaaaactcttttacttacaaagagaaaaaatattatagctttctgtcacacagtagaccatttagatcgggtctgcttagttgtgagattgttaatatcgcagagataagttctaggcaacgttcacagctatggaaaatatgagtttgagatgacatatgggatatacgcacattttcccagtcatctgggtatacacatccgtgaatttcagtcaagtattgcttgatatgctcttctgtggcttgttcaacccagagctctagctcagtttgatactggtgtaatattttccatcgagttggagggaaattcatatatttatcctctatcaaagttatttttgcaattatttcatcaatgaagagagttaagaagtatttttattactcactatatggagagatatgttatgtggaaaaaaattaggattgattttactgatacagtgaaatgtcaattttgcagtagaatgattacatcaggcaaagctattgttgttcaaaatgaacttggcaatatctctttttcaggaccgtcttgtgctcaaaataagaacggtcagaatgtagtcaatcctaaagagaaaatagttgatatcacaaagggatgtttacttcatgagccaacaacaaatgataaaacggataagcaagtagatgttgagcaagataatttcacatccatacacgatgacgaagtacataattatttggacaataatgctgttaatgcatacctgaccttaagatttgaaaaactatcgcatttaacctcgattataaaatctcaaaagttaaatgaaatctatcataactatgaacttacagggcaaatatctcaaaaagatgaaagttacataagagtgattatgtatggtgaggcatatcctttgtatacataccaaaacttacaagctgtttatgctgctgaatattggcttcaatcatttattcagcataatccaaagaatgacttaaattttatacaagacacattaaatcagctcagaagaaagctaacattaactgaaaaacagattatgggcataaataattggtttaagaattctgatggaaaaatggtgaaattaaagacaaatgcttttgtaagagggaaatagttaacataattgtggtggccacttattttgttacgtaggcccgacgtaagactggttttaaaagactctttcctattatttgcttgcttattttgacaaattcaagttatatgtaattcaaaacggttgtttctatatcacttaggaatgtaaattataaaattcttttaaatcaattaattaaatattaagtttcccagattgaagtatgagtacgtaaaaataaagtataaaaagactaaatttcagattttatttttacacaatgtacttactataaaataccaaacagataatatttgtccataaattcattgagttgattatgccatttttacacttattgactatagcgttttgcctaatcatctgtctgattccasttyyacccttttcccaatatctttcaatttcgayaamtytyccacyaatcttgctacatattcaagaaaaagtgcgatcgtttttcaaaggattttatgaaaacgaccgctgtaagaaagaatttttatttacgactttttcaggtatctgaaaactatttcgcttctgaaaaattcaaaattgcttcaggcaaacgcaagccgacaatttcaatggcttctaattcttggcggaattgcgccaattcttcttcggtaaatttcacatcgtctgcgcctaaattatccaacaaatgacgggctttgctcgtcccaggaattggcgcgataaacgctttctgtgccattagccaggccaaagaaagctgtgcaggcgtacaaagtttgcgttttgcccatttttgcacaagctggattaacttcacattttgttgcatcgcttcgggtgtaaagcgtgggataataccacgcaaatctttgcttggatcagcctcaaaacggctgttctcgtccacataaccagccaatgctcccattgccagcggcgaccaaggcacaaacccaatccctaattcttcacaaacgagaatgacatctttttcacgaccacggaaaaacaacgagtattcgctttgtacggcggttaaaggctgaatagcgtgtgccttgcgaatggttttctcgcctgcttccgacaagccccaattcaaaactttgccttgtttcattaaatctttaatagcgccagccacctcttcaatcggcacattgggatcaacacggtgttgatagagtaagtcaatacggtcggtttgtaagcgttttatcgtaccgactattactgaatggcgtggttgggtagatatcgcatcaattgcatcactattattagctacctttcctatttttattattttactcatggaattaaaagttattcataaaaatctcgtggatagtgcaaaaattaaattacatgcggtttatcttgtgattttcttatttgtgagtcactttgctatgatctttggcatggcagatcctatttcagcaggctatcaacccactacaccagcaatgactcattcaatgcaaatggatgctaaacaaataacagaaatgcacaaccaaatgatgacgggcgaaataacgcctgaagaaatgatgaagatgcatcaagaaatgaaccctaatatgaatatgccgaatactcaaggtggtcattcagaacatcataaataataattctgatcacattttaaaaaataatagtggatggtacgttggcatatctctactacaagcagtaggattttgagaaaaattttcaaatgatagaattttttcagattacttgaccttaaccctaggttaagctttaaaatgatgtccattcaatctcaataaaaaataaggacatcttatgaaattacataaattcacccgctcattgttgcttttaagtttaggcataaccgcttttgctcaagcacaaacactttctatggaagtgtggaaaagcccgacttgtggctgttgtaatgaatggatcagctatatgcagaaaaacggttttgaggttaaagtcaacgaaacaggcaattatgatgctcataagcgctttaacattaaatatgaacatgcttcttgccacacagccgtgattgatggctatgtgattgaaggacatgtacctgctgaggatatcaaacgtttactcgcagaaaaacccgatgcaataggcttgtctgcaccgggaatgccaattggttcaccaggtatggacggtgaagcatacggcggacgcaaagatccttatgatgttgttttgattaagaaaaacggtgaaagtgaagtgtttaaatcctataaccaataggggggggggaaagaatgaaacgtcgagattttttacgttatggaattggaattagcttagccagtagctcgctttatagcctcgcgaatatgatgaaccacgcacaacatggcaatatggcgatgatgcattcagtacctactggcctaatgccaactgaggcaatgccttcaggtttatcgcttaatgggatattaccaaaacttgctaatcaatcgactcaagctggactgttcaaagccactttaaaagcagagccaattaaaattcgcctcgcagacaataaagaaacggaattttgggcttataacggacaactaccagggccacaaattgaagtatttgaaggagataccgtagaaattgaatttatcaatcacctaccacaaccctcaacagtacattggcacggcttagatgtaccaaatgaggcggatggtaacccgatggatatggttgaaccgcaagggaaaaaagtctatcgctttacgctacctcaaggcagtgctgggacatattggtaccaccctcatccacatgaccatgtttccgaacaagtctataaaggcttagcaggcactttcgttgttaaagcgaaaaatgatccgcttgcacaccttcctgaacaacattgggtgatttccgatctgcgtttaaatgccgatggcaccattccagcaaacacgatgttagattggataaacggtcgtgagggtgaatttgtgttaatcaacggtcaatatcagccccagattcaagtgaaaacgaatgaacgaatccgtctttggaatgccactagcgctcgttattttcgtttaaacattccaggggtgaaatggattgtggtgggtaccgaaggtggtttacttgaaaaacctcgctcgcctgttgatgaactgctacttacaccagccgaacgcgttgaagtgattatggtgggtgaaacgcaaggaacagtcaatttacaaagcggttattatgatcgccgtaagatgatggttcaagaacagcctaaagatctcactttagccacaattcaggtgaaatcagaacctgttcagttacctgaaagcttaaggtccttgcctaactgggatgagccaaagcaggttcgccaaattcgctttagtgaaaaaatgatgaaccatacgaatatgccaatgatgaatcacggtacacatcacgctactacaacactaacggacaaccctattccaccaatgatgaatggtatgttcttaatcaacggtcaaacctttgatatgaaccgtattgattttgttaccaaattgaatgaagtggaacagtgggaaatcttcaatgaaagccatatggatcatccattccatttacacggcactcaatttgaagtaattcaacatacgttaaacggtaaaacctttaagccagaaggcagagcgttaaaagatgtggttaatttacgcccttatgaaaaagtgattattcgctttaagcaaggacatactgggttgaaaatgtaccattgccatattttagaacatgaaaatctcggtatgatggggatgtttaaagtggaatagtggtatctaactataaaaatagagggatttcgtcataaaaaatctgcaccttaatcagttggtttttagtccaacttttggggtgcagatcagacgctcactttgtcgccgatttgaaattcgccagcgtcatcgcccactgccacgaccacgcctgcccctgcataacccaaagtcgcagggaacacagggtcaatcacatacgccccttcccgatacatcatctcggcacggtttagtcccaatgcacggcacggtttttaaacattttcattatagttttccttatcaaaatgggatttggcaaacattgggcaaacctaagcccgcccaatgtttttagttaatcaattacttgcaatcacaatcgccacaagtgcagttttgacaaatgcacagctcgccattttggcagttgcattttggattgcaattttgccctgtgcaagattggcaaccgcagtgggcgtttgggtttttgatgatgtcgttcataacaattctccaaattaaaggttgattatcaaaacaaaaaccgtttttaagccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacggcacggtttttaaacattttcattatagttttccttatcaaaatgggatttggcaaacattgggcaaacctaagcccgcccaatgtttttagttaatcaattacttgcaatcacaatcgccacaagtgcagttttgacaaatgcacagctcgccattttggcagttgcattttggattgcaattttgccctgtgcaagattggcaaccgcagtgggcgtttgggtttttgatgatgtcgttcataacaattctccaaattaaaggttgattatcaaaacaaaaaccgtttttaaacccattaataaaaaaatgccatttaaaacggtcacttttgcacaagcaacaaccaatgatggtcaatccttattagcggttaatgacttatttattggccctaaaagccacacttccgcacagtatattttgcaatggaatggcgctgaagaagtgcaatcttcatcaggcattattgtatcaacaggattgggatcaacggggtggtttcaatctattcttgctggtgcgatggcaattacaggagaagcttcgcaccctctattacaaggctttagctggagtgatcgaaagctacaatttagtgtaagagagccatttccaagtagaacaacaggtgttgcactgacttttggcactattgagcctgactcaccactgcaattaggatctttgatgccagagaatggcgtaattttctctgatggcatcgaagatgactatttacaatttaatgcaggttgtattgctcacattggtatcgctgacatacaagggcaactaattagccaaaaagggcgtcagcgaatttagatttatttagcgctctttaatactgtttcaagtccagagatcatcacatcaaggacaaacaaaaatgcagcatcaccattatcactatccataattgcaacggcttgggttaataatggcggataggcaacagtatccgtctctactttttcacgctctttttggctttcttgatgctcttgagtttccagtacggagcctaatgtaaaatgcgcaatagagcttaatgcatacacggcttgagatagactaaacccagcatcacacaaaaactgtagttgctgttctgatgtctcaaattgactttcagaggggcgtgttcccgcatgaattttgccaccatcacgatacattaataaggcttggcggaagcttttcgcgttatttcgcaaaaagtcctgccatgtttcattcggcaatggcaaaacatgatgatggtgcttttgcaaaatagtttctgctaatgcatctaacaaagcgcgtttattttttacatgccaatacaatgtgggttgttccacacctattttttgcgccagcttacgcgttgttaatccttcaataccaacttcattaagtaaaatcaacgcattatcaataacttgttctttatctagctttgccattacctacctcaaaataaaatagccttgacaatctatcactgatagagatattctacacccactctatcactgatagatttttaggatctcaatgaataaatcaattattattatactgctgatcaccgtattagatgccattggtatcgggcttatcatgccagtactccctactctattaaatgaatttgtcagtgaaaattcactggcaacccattacggtgtgctattagcgctctatgctaccatgcaggttatttttgctcctattctaggacgactgtctgataaatacggcagaaaacccatcttgctgttttcccttttaggcgcggcactcgactatcttttaatggcattctcaaccacactttggatgctctatattgggcgcatcattgcggggatcacaggcgcaacaggtgccgtatgtgcatcagcgatgagtgatgtgactcccgctaaaaatcgaactcgctattttggtttcttaggtggtgcttttggtgttggccttattatcggcccaatgctagggggattattaggtgatatcagtgctcatatgccatttatttttgccgctatttcacactcgatattattaatactctctttgctctttttccgagaaacacaaaaaagagaagcgcttgttgccaataggacacctgaaaaccaaactgcctcaaatacagtcactgttttttttaagaaaagcctctacttttggttagcaacctattttattatccagcttatcgggcaaattcctgccaccatctgggtgctgtttacacaatatcgttttgattggaacacaacttctatcggtatgtctttggcggttctgggtgtattacatattttctttcaggcgattgtcgctgggaaattggcacaaaaatggggcgaaaaaaccaccattatgatcagtatgtctattgatatgatgggctgtttattattagcgtggataggccacgtttgggtcatcttaccagcattaatttgcttagcggcaggaggtatggggcaacccgcattacaaggttatttatcaaaatctgtcgatgataatgcgcaagggaaattacaaggtactctggtgagcctaaccaatattaccgggatcattggtccccttttatttgcctttatttatagttatagcgtcgcttattgggatggtctgttatggctgatgggggcaatactttatgctatgttgcttattaccgcttattttcaccaaagaaaaaccacacctaaagctgttatttcaaccccttaatactagaaattataaagatcataaaagtcctgtccgctcttaataacgttgataggactttatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatagaaataatatgtattctgaaagcgttgttagtctattatattgatgactaagagatactgaagaataaatatcaataaattgactcctgcctttcattaacacactttttttgtattgattacattcttttgcttttttacatttattctcatatgttgaataagagattctaactcgttttctgttaagagtactttgttatgaattagatcgctaataacaagattattctgtttttcccaattcattatccactgtatagttcccagcttatttctaattgtgtttactgcggattgattacgtagttctacagttacccataaggttgaataaaaatcaggaataccagtttccacattaaccaatagaggaaaacgttctccatttgaaaaaaaggactgtttctaatctatgcatatctatttaatttacaaaaatmtcatatataaatactatcaaattaaagatrttgtgtcraaattaatgtaaaaaaagagaamccttttaaaataaagggttctctatatttatatgggttttattttacagttttaaattatatgtaactcagaacggaatatcatcatcaaagttatccattggtaaatcttgtggatgtgttgcttttggagattggctcatagcttgatagttagattgttgtccatctacgctatttgtagcattacggctatctaacatttgtaatagttcaccttggatttcggttgtataacgctcttgcccgttttggtcttgccacttacgtgtccgtaattttccttcgatataaattttagagcctttacgtaggtactgaccacaaatttcagcataacggcgataaaaaacgatacgatgccattcagtgacttctcgacgttctccggtatttttatccgtccaactttcagaagttgccacactaatattagcaactgcttcaccattaggcatagtccgcatttcaggatcgttgccaagattaccgacaataatcactttattgattcctgccatcgtatttactccttcaataaattaagttagttctattaaacttgattcagcctaagaaaaaagtatttaattaaaatttggttagagtgaatttttcatttttacgtgtgcaatcacttattcctccgttgtaaaggctttttcttcgtgaaggtaaggggcttgtacccttacctttaaaaggccttttaatgcaggatttacaaactgcactttttcaggkattacaaacttgaatatgtcctaattaacggactgtttgttttaccacgtcagcccaccgtggttggcgtttacacacaaccaatataggagttgttatatataaatttactacgaatttaagtctgatttcgcaacggcattatctacctctttcaacttttcagcacaatctgccaactgtcgcaaaatatgattaaacaccgaaatctgcatattaatcaaaatcctgtctttttctactgcgacaacttttttcctcacctccactgggacagacttatcatctacaatcggctgccaaactgtgccaccggttctggcattttgcatactacgccagcgtaaaaatgtaccgcctgaggatgaggccttatccttaatcatataaacagccaaaggtgaaagatcctgccgcacagactgcaccatactatcctgtgcagccataaaataagcccgagcttgagtgaactgttcttgcaaaagttcatagtctgagccagtgtcaaaatggctaaatagctgtttcagagaagtattcagcccagaatctttgactaattgccgataaatttcatcagagatgaggttcatatcactccttatttttgagattcatttgtctgtgccgtgatatgggtttctacggattgctcttcttcaacagtagtgttttgcttgatgaagggagcaaactcagcacgatgctcaccggtaagtacagcatctgagagtgtatagcccattcgttttatcgcagcttgatagcgagcattcttttcttgatagtcccgacgagtgattcctgaactcttataacgctcaacgatcccaaaacatttccggattaaccttgcaccagcttcaatccaatcttgagcttctgcacgattgataatcgcaatatgagctgccgtcattactgaacggcaaaggctatcaaaatcaccaagtaagtagagtaattgataccctagctgtgaattaacataaatcgggtaagaaatcggggaaatattggcacagcgttcaatagaaattccctccggcaacattttggcgtagagcgtgacaatgtcgttggtgagcttttggatttccttccgataattgatcacactttcttcaaattgaatcagataatcgtcagcataaggatcatcttctgatgcagcccgttgaatttgggttagcattgcaaagcaatttggtacgctgataatggaggattgagttactttgccttcctcattacgaatcattggtcgccccacccataatttatgggcatattgggtatgtaacgtaaaagtgatctcactacgaagtggaccaagttgaggatctaattgagtggtcatatatgctccttgtttatttgattattttttagtctttggaaaggggctttccattgtctgttttttaatctttgcagacactgcctacgctgtttattttttatccattgtgtacctggtacacactgattatttttcactcactattaagccccttaacagtgattgttttttaatcttattgtaaaagtaattcagctctaaacttctgcatacgactagccatttgctctctgtctgctgaagttaagaccggtttctcagtaggctgctcagtcagtttttgtatagaatgagcagaattattgttagcctgattctgtgagggaagattttttcctaattcaaaatagtagggtttaaattcaccctgcttcgcccgctggataagcgtatagagataacctttcggttttttcacatcctgcttttgaataatgcgttgttgtacttccaacaaaatagcttggcataaaccgaggtctaatcccttcattgcctgtgcagtaagtttttgttcaagtgaagttaatgggatttcttgtggccaagtaatttcgctcggttccccagtacagtacttattaatatataaagtacggtactgtacatctgacttccctaatggaagtaagtctaaaatcaatgacttatcttcatttttagccctaactcccttattggaagtctggtttttagaggattttttcctgacttcctcatcaaaatccctaacttccatagtggaagttaggatgttttgttgaattttgcttaattcttgttctgtttgcgatggctgtttatctttcaccagctgctgttgctggtatatctgataacgactttgtaaacagtctaaatgagagacatagtgccatttggttttgtctgttattagactttcaacaatatgatttgccacaccattaataaggctatctttatgtttggtgcatttatctaaaaaagagagatagtcgctatttaattgaattgcatctaaaattggcacaggttcatcatgtaggatataaacattaccttgtacataacctcgctcatcacgcactgtttcacataaagtaagccagcgagtaagacggagtaaatagagtgtttgagtcacgactttttccgataatttagcctccgcataaggtctatcggataacattttgctgagcgtctcataagagggaaataatcctccttgaaaggcttgaacattgcacttaatgagctgccaagcaaactttgctcttggtgtaaggcagggatcttgtaataatcgagtagggactgtttcgtgttggttgccaaaaaatagcaatccatgctctgttggcttattcgtgctgctaaacattgtttctctccaccaggataaaagagtttttctcttgctattctctctcctatggctataatgcacgggacttctgcaaagtccttgtaattcataagatagagatacaagactcaatatcgaatgccccaaagctccaacttcggggcatttattttttacttatgttttgaataccattcggaaaccagtttccaaacaaccgttagattcatattgccttcctcagcaatcagacatagaagctctaatccttcttgtgaatctaggatttccattcgttgtttgtatctttgccaaatttcccaaatatgggtagattcttcatcacttgctgccgcttttcgtcccattttttcttcgataccgagtaattgacggcgagccgagacttcagaggttgataaaccaaaatactggtgcaacatttcaatagaggctccgagcaataatgctcggtcaataatttgtcgctgttgagtattggcttgtgcaatagccagtaatttccaaaaggtttcgtgattaatctccaccttagcaaaagagacaacggagttgctaatatccataatttcatcaatactgagattattgatcgcttttagttgctcctcagaaaatcccatttttagacaaggatggatatttccctctttaatattgagcagggcgttaccaatcaatgcttcatttacggtaatcggcttaatcattttctcctccttgttggcgaatatggcgactgacccgaatgagacggaaaattttgactaaggtaagatcatcaagctcaaacaggaatttggaatctaagacacagctattttcatctttatgttcagcagtctgtaacattgagaggaatgagtagagtgttaaagcagacggtgaaagttcagtatctgccggtttcattgcataagtgtaatccactggttgtttcacaatatgttcaaccagatggtcaatgcccatactttcggcaatatctaaggccagtgagtaggcctctgagcgatattgacgtgcggggtgaatcaaccaaatatcttcaaccggttggcgaccttcacaagcaaaagtcagtccattcgcttcagctcgttgctctcgctgttcttgaatactcattcccggagtgagtccaaagttatgggcaatttgggatagataatcttcttgattatcttggttatcgagcaatgaagagccaagctgagataaatcagtaatagcgttattctgctcatcatcactttcgttatcatcaattacctcatcaataatatgttgagctttttggggagtaacggctttattttcatttttgatgagaggttcagattttgcagtttgttgttcctgtctggtattgatttgatcgactgttttttcaactaaattatcaatttcttgttgtttagccgctatttttttgaatttttgttcatctaagtcaatatccagataaagtgtttcaaaactcactttaccctctaaagcttcaaccattgccgtaatcaattcactttggaattcttttgcttgaaatggtgtagcctcattaaatttggataaattttctgaccagagcgattcaaaagtaacatcagtatcaaattgatgggctgcccatacctcttcagcattattacgaatagctaatagtttatcgatctgtgtatgaccaagaccactaaaaagaacttctggtatatgtggatataagtaattaacacaacgttccattttaagaatgagagcatgagagataatatatccatcattttctaactcagaagataactctctcgaagaaagagacttacctaattttttctcgtaatactccttcgcctgcwraatccccaatgctttytcaataaakgwyaaatcygcacgggtrtcattytcaatyaaatgmccgatmagyaaatyragttcmgcttcsacactrtckgcmgtmtcaccttkccaaggtttatattgacaactgatggaccaaaattttggatctttggtctcggtaaagagctccttgagtgcctgaatacgagtattaccaccgtcagcgataatatagaaatcttctcccggacgacgggtgatattcggcttatgatctaaccctcgacgacgaatagactctttgatcatctcaaagttagggttacgggttttccgagggttatgctcatacggacgcaacttatccagcgttactgtaatatattcaacatcgctactgtaatgcgttggtgtggctgtttggtaggatggagccgtatttgaaataggtgaaacatttaatccttttgctatcgctgccagtcttttttcatcttttgtcataatctatcctaatgcgttgtgtttgttctgttttcaaatagggcaaattcacttctgaaattcgtcattacggaagtaagtggtccgtttctttgcttgccgataatgatttcagcagtgcctttaaacggagaatccgcatcataaacttcatctcggtagatgaataaaatgacatcggcatcttgctcaagtgagccggattcccgtaaatcagagttgatcgggcgtttattggcacgttgttccacagaccggttcagctgagagagggcataaaccggacaatccatctcttttgccagtaatttgagtgaacgagagatgttggcaatttctaaattgcgattttcataacgttgcgaggtttgcattaactgaatgtaatcaatgaaaatagctgccggtttgccatatttacgagcattttgtcgaactttagtgcgtaatttttgaggcgtgagactaccttcatcatcaataactaaacgatttttccaatgttctaggatatagcccattgctgaggttagttttgaccattcctcatcatccaaactgtctgcctgtctaatattttgcaatcccactctggcacgcatagctagaaaacgttgtaaaatctgatctgccggcatttccatgctgtgatagaacacaggagccgactcgaattttttaagtgtatggtaagcgatagtttgagaaaatgcggtttttcccatagaagggcgggcaccaatcacgattaaatcgcctggctgtccacctgttgtcgcttcgtcaataccttgaataccagttggagtacctgtcacaggatctccatttttagccgagagttccatacgagagagcatattggcaaaaatatcacttaaatctgctgcagattttgtattatctgataggctaaactcagtaatttttttctcaatgtcatcaacaacagcttcaaacttatctggcgttttcgcactctgtgtctgatcaacaataaactgccccagttttaaaagctgtcgctgtttactatataagagaacgatatccgtataagcgtggatattagctgtagatggagtgtttttgactatttctgcaagataagcaaatccgcccaaatcctcgatcacttttttctgggtaaggtattgatccaatgtcaatatatctgctggtttaccggcttcaatcaattcggaaatatgcttaaacagtagacggtgagtaaaattataaaaatccccctcattgattttgctactcacttcatcaaagagttcattatccaagagtaatccaccgattactgaaaattcagcctctatagaatgcggctgtacaagtgatttatttaagctagacatacattctccctctatgctgagaagtgagagtttgcaaactgtggcatcagtaacgcacaaagctgactgatcgtttcatattcagcttggctctgacgatagaccggttttgaaaaagttgccgcttcacgatatgccacgcggtcaggtaccgaaaattccagcaatgttttgttttcatcaaactcattttggaagagagtatgaaggtagtcggaaaccaatttgacatctttagtgtgatcaacacagttaatcatcgctttcagcggtggtagggtaaagccaaatgccgtaaaggtttcgaggtcttgatacattccaatcgtgccacgaataaactccttagcagataaaatgtggggaagaataggacagaataaaacatctgctgccaatacagacatatcgacagtaatatctctggtaccacgagtgtcaataatgatgacatcgtaaccttcaattttctggagcagtaaactaaaacgtaatgcaccgtcaggtgaatctctcagcattgggctgattttatttgacgggtcattagactggatcaagtcaagatttgggatagtcgttctagaaataatgtgggtaggatctacatctttaaaatgcagaaattcgtaagttccaccgggagcttgatattccaactcataataagagcttaatgtgggttgggtatcggtatcaataagaagggttcttagaccgtgttctgcacagaatgcaccaatgttagcagcattcgtactcttggcagagccacctttagttgaagcaatagtaatggtaaaaggtttgtttgtaccgttttgtaatggtttcataatttactctcttaacaagggttaaggagtattggccattaatacggtgtatttgaattgattatttgaaagagagaaactacaagtgtgattcaaatggtgcctgaggtcggactcgaaccgacacggttattcaccaacggattttgaatccgtcatgtctaccaatttcatcactcaggctaagagtgctttttattcaatcgcctgtatgtcctatcagtttacgcataagattttgaatccgctacgtctaccaatttcgtcacactggctgtgtgctttattgctcgacattatacgtttataaacttaccttgcaagtggtaatttaatattttggtttatttgttttaattttcaacaaagttacctcaaccgcactttacaaaaatattttatagtaaagtgcggttgtttttttactctctttttctattaagaagccaccaaatgagaatcataaaaagtaaacttggaatgagggctgcaagtacaattggtatatcatacagaaggcttaatcgccctaaaatttcgttgataacataaaatagaaacccaaaaaaaatacctgttacaatccttgctcctgcagtaacactgcgtaaagatccgaaaataaaagaaagtgccaacaacatcatcaccgcaacagagaccggttgaaagactttttgccaaaaagtaagttcaaaacgtttagcatcttgtcccgtttctttcatgaatttaatatagttgtataatccggtcatagacaacgacgttggacgcaaagaagctatccccagcttatcgggtgttaacgttgtactccaattatctttcaagcgattaatcgttttaatttcatcagcaaaaatttgtgattgattaattccgcttaatttccatttgccatgttcaaaacttgcttggttcgcatgtgtaacttgtttcaattgacgcttatcatcaaaactataaatataaatatcattcaacctaatatcattagtaatacgaccaacatagataaaatcattaccatcttttgcccaaatactattttttactgaaagcatggagcctccggaaattgcttttgcacgcatatctctggcaaagtgttccgtctgtggaataccccattcgccaataatcattgtgataagcatcaatggcaatgcggttttcatcacggctaaaccgattctaaagcgagaaaatccagcagattgaatcacaataagttcactacgacttgcaaggttaccaagtgcaataagtgatcctaataatgcagccataggaaaaaatgtttctatatcttttggcatagttaataaagtaaacagtgttgcctgaataacatcgtaagttccttttccaatactacgaaattgttcaacaaatttaataatcgctgataaacccaccaacatcagcaatgtcgccaaaatagcacctaaaatattttttccaatatagcggtctaaggtattcatcatcattattcctgattaccttttacttgaattaaagttaaataaataacgtattttatacataaaaacactattccaactgttcaataaaacagctaaaaataaaaagaaaatactgactaacggcataaaaatatgtgcttcaattttaccggaagcccccgctgattttaatgaactttgtaacaagaaataaattaaatacaataaaagtgcgggcaaaatcttagcaaaccgcccttgtctcggattgactcggctgagcggtactgcaataagtgccataatcggaacagcaaaaattaaggtcaaacgccaatgcaattccgccttagccgcaggtgatttagaattaattaattcctttaggcttaaaatttccgtttcagatgtatccttatctgttgtcttataatctaaataggcttgatactggtcaaaatgcgtaatacgaaagtcaggtaaaagtgcggttccttcaactcgctgactattttctagactaagaacttgatcgccattgggtaacgccttcaactgaccggtttcagctaccgttacggaaggcttctgattttttttattttccatttggaaaacataaatatcttgaatttgattgttttttatttcattgataaatagcacaacatcagtatttccgacattaacaaattgtcccgacgctaaagcccccattgttggatttgcttttgcatcatcaataagttgaatttgtttttgcattgcccaaggggacagataaaacacattataggttgccaatcctgctgtcaataaagataaaattaacgcaacaccaacaagaatacgctgaccaacaccacaagcccgcatgacggtaatttcgctttctgcatataaacgtccaaatgtcagcaatatagcaataaataagcaaaggggaaatataagttgtgccatcgtcggcatacccaagctaagcaaagcaaaaaccaaatcagccggaattttaccaacagatgcagaacctaatacacgcacaagttgttgactaaaaaaaagcagtaaaagaatagataagattgcaatttggcttctaaaaacttctttggttaaatatcgaattaatatcactgaattacctatatttctcttgcaattttaaaaaaaagcagtaatttacgaaatcacatacatggcgatgtatgataacgtatttttttattgaaaacagtaaattcgtgaggattacatgaaatatagtgcaaaaaataccgcactttctcaaattgacagcaacattattttagccgtatttgagggcggaaaactttctccgacagcaatgcaatttgatcaactcagtcaaggctacctaactcgcttaattcaagtaggtgaagttagcggaaaacagggacaagttcttattttacgggatataccgaattgccaagcacaacgtatttttatcgtagggtgcggtaaaaaagataaaataacagaacgtcaatataaacagattattcaaaaaacaattcaaacgattcttgagactcaagcaagtgaagttgtgagctttctaaatgaaattgaactaaaaaatcgtgatattcattggaatattcgttttgcaattgaaaccattgaagcaagtcattatcaatttgatactttcaaaagtaaaaaaactgatgcaagtttagtattggatagatttatttttaatgtgccaaccgaattacaacaaaatgcactacaagcaattagttacgcacaagctattgcattaggagtcaaatatgcaaaagatattgccaattgcccgcctaatgtttgcaacccaacttatcttgccgaacaagcacaatccctcgctaaacactcaaacttgattaacgtgcaagttttgggtgaaaaagaaatggcagaattgaacatgttctcgtatttagctgtttcgcaaggaagtgctaacgaagcaaaaatgtcggtgattgaatatcgtaatcaccccgataaaaatgccaaacctattgttttagttggaaaaggtttaacctttgatgccggcggtatttcattaaaacccgctgatagtatggacgaaatgaaatatgatatgtgcggtgcagcttctgtattcggtgttatgtacgctctggcaacattacaattacccttaaatgtaattggtgtattggctggttgtgaaaatttgccggacggaaattcatatcgaccgggagatattttaaccactatgtcaggattaaccgtcgaagttttaaatactgatgcggaaggacgtttagttttatgtgacgcactcacttatgttgagcggtttaaccctgagttggtcattgatgtagcaacactaacaggtgcttgtgtagtggcattaggtcaacataacagtggcttaatcgcaacagatgaaaaacttgctgaaaaattattaaatgcggcagaagaaacgaccgataaagcttggcgtttacctttaagcgaagagtatcaggaacagttaaaatctaattttgctgatttagctaatattggtggacgttggggtggagccattaccgccggtgcatttttagctaactttacgaaaaattatccttgggctcatttagatattgcaggaactgcctggttacaaggtacaaacaaaggtgcaacgggacgaccggtaagtttactaacgcaattcttaattaatcaatctaaataactgcaaaagtgagagtttctcttttagaatatgagtatcaaaattcaatctaaacaaaaggagactctcattttttattccactgatccatttggctgagatttccaccgcacttaccttctatctatcgccatcattacttaactaatacaactaatccagaattttattaaactttgatctataaaatttcagtataaaagatgattttatgaatgaaatgagctaaagtagccgagttttttagcaaggatgatttttaaggatacctcatgaaacaatctctgcgtcataaaaagataattgaattaataaaacagaaaggctatttgagtacagaggaattggttaacattcttaacgttagccctcaaactattaggcgagatttaaatgaattggctgaaaataatctgattacacgtcatcacggtggagctacttcactttcaacatcagagaacagtgattatagtgaacgtcaacatttcttctcgtctgaaaaacggcgtattggtcaagaggtggcaaaaattattcctaacggttcatctttattcattgatattggtacaacaccggaagctgttgctaaagcattattggatcatcaaaacttaagaattgttacaaataatcttaacgcagcctatattttgatgcaaaacaaaacatttgatattacgatggctagcggatctttgcgtcaagatggtggtattattggtgaagcgacaattgcatttatcggacaattccgtttggatttcggaatattaggcatcagcagtattgatttggacggttctttattggattacgattatcatgaagtgcaagtgaaacgtgcaattatggaaagctcaagaaatactattttagtaacagatcattccaaatttactcgccgagcaatggtatatttaggttcgttaacagaagtagactatttgtttacagacaccacaccacctgactccatgcttagccttattcattcaagcaatgtaaaactgcatatttgtcaatagaaattttatcaatagagatgtgtagaagattttatcttctacacaataatcaatttaatgccctcgccaataaactgacagggtgtaaacaagaagcacttgttgacatatcaatttgccatttgcaagtttcacattcagtgatgacataatcgaaacaaccttgttcaataacctcaaataaactttttccgatggcctgtgaagtctgatagttttcagatttaaagccatatgttccagcaataccgcaacattgagacggtaaaatagtaacatcaagatccggtatttgtttaagcaatgccaacgtataaggtgcccaccccgctttttctacatggcaggcggtatgataggcaactttaagaggtgtagacttaaagtgcggtatttttccatcaagatatagtcggtaaagatatttggttgcaatattgacatgaggacgaattctcgcattatccatccccaaaatatgatgatattcatcacgtaagttcattgtacaacttgaagatgtaccaataatatccaatgctttttcttgaatcacccgttcaatttgtttgatgttaaactctgcttgttttttagccttttcaggaaaaccgttcaccatgagcggcaaaccgcaacatttttctttttcaagcaaaatcacgccaatatcaatcgaattaagtactttaatgagatctttgccaagttgaggataattataatttacataacaaccgtgataatacactatcttatcccgaaaatagatctgacggtcaagagcatattttttataccattgacggaacgaaccgaatgaatattttggtaaagtgcggtgcttactgaccttaagggttttatctaaaacatatcgggttgcttttaatccggtaatcgcatttacaatcggagcaaaaggcgtattcattttacccatgatatccgtattacttaatacagcatcacgtaatttatgtattggtgatttatgttgttggtcaagatatttatttctagcacgaatgataatatcaccaattttaacgtctgacggacaagcaacctcacaacgtttacaattgatacaatattttaatgcttcatcataaagtgccgcactttttaagcgtaaccgttcaccgtccggtcccgcctgtttaggtccgggataaaaaggattttgacgagaaacagggcaaaccacagtacaagcagtacattttatacagctctcaaaactttcatcggtatggtgctgagtaataggaaaagcagcatgttgttttgcattttcaatgagttgttgaatattcatattttgccccttatactcgattttgtgcttcgataatgttatcggcagctgttagtgcagtaacaactgccactccggaaccacaccctagttccaatgcattgtatccgccaataacatttccagcagcatataaatttttaataatctgaccgctcttttttaattggcaacggctgttaattgcaacgcccgcagactgataaggctgaggtgaagaaaaacgccgagcagtccaagtgagtctgttttgtatatcaatcattgaattgccaatcatgtccacgtcaaatataggttcaagtaaacgatcaaaaacactcaccaaaccattactgaaaaaactaccggaagcaagaacaaaatgttctgcgaaaataccatgttcttgatgtaattgagtgtaaatttgtttaacctgttgatcctcaataacggcacgcaatgctttatcaccatttaaaataaaaccgcccagtttttcaaaatacgtttttaattttttatgttgacgcaatcccactaatgaaggcggtaatgtaggcaattcgtataaatttaatccagtttccaacgttaatttattgaaaaaatcttgattatccaaaccgaaacaagccggtaaaaaaattgcttccccatctccggaggcttgttttatttcctgtaccaattctcgaaacgccaaacgatgttcaagtaattgggaaatattgacactgcgaaactcacgagaagttaaacgcaattgatccaactcgggaagatgtaaaagtgcggtcgttatcgaacaatgtgtaaattgcggatgctgtattaaattttcagccagtaagtgcggttgaaaatcatgatacccttcaatgcccaacacagtaattttttggtatccgaaatgttcatcatgaagatccattgttggaatacaatcagcggacagccaagtgcggtgtaatccgcccaacggtgtaacacgaaaatgattttgcttatagcttcccgtcacattgagattaattttctctattaattgttcaaattgcttggctttttgtaaaacatgttgtttaccaaacaaacaatacggatgatttggaagttgttcttcaaggctgtcataaccttgttcaaaagaatttatcttttcaccgtttggtaattggcttaaaagatccattgaacctgatgaaaaattcatggctgattgaccattattaataatcgcacaacatttccctttttgttgaagcataattccgcaagttaaccccgcaagcccgcctccgataatcactacatcaaatttcattgccatctgttccttgctgtgcttgttcagttaaagattgaacactatttaagcctaataaactgtaatatatccaactggaaaattccgcttcacggattgcttcgccccaagcaatcggttcaatacctcgccaacgttcttccataaaagatgataattgcagtgtagattgtctaggtgttgccatatgaaaacgtgccattaatcctgccgcacggcaagcacaaagttcagcctggcaagttcccatgcccacacgtgtacgacgacgtaaatcaacaagattattgactttcaattcttctacagcataacgtacttcaccggcagtcaccgcttcacattcacaaacaagtgtacaatctgaccgctcttttccaatcaaacgagaagcccgttgcccatgacgataacgtgcggaaatttgaagaggtgttggtaacgatatgattttattaatatgaggaacattttgatcagattcagaacctggaagtaattcttgggcagttgtacaaacagtttgtttgccaagttttttactaactaaatcagttgcccattccgccatcaaacgataagtcattaacttacctcccgtaatagtgacaaaaccttcaagaccatcacggcttgcatggtcaagcaatacaataccacgactaacattacgtcctgatggatcatcatcactcgctaccagaggacgaacacctgcataggcacgaagtactctagtatgacgtaaactcggtgcaagtttttcgccttctctaaataaaatatccacctcttcgggagtaacaatcatattatcaatttgatcataagggatacgatctgatgtggtgccgataacacagatagtatcgccaggaactaaaatatccgcatcagctggtttgcgacatcgattaattaccaaattattaatgcggtgccccatgacaagtaatgcacctttagcaggaaacatcttgactttgagatcggcatattcagcaatcccctgtccccaaattcctcccgcattaacaataacctgagcaaaaaaacggcgatttattttatttttgtgatcatatacttctgtaccaatcactcttccgccttcacgaatcagttgagtaactgcacaataggtaaaaattttagctccatgctcacgtgcatccaacatattggcagaggttaaacgaaacggatcaattgaaccatcgggaacaacaaccgcacctataagctccgggtttactgaaggctccattattctggcaaggtcaggctcaatcggtactgcttcaatacctgcttttgtacaggattgaataaatatcttttgataattaagatcgtcttcaggtaacgtaatgaaaagccctttggtatcttcaacacaatgacgtgcaatacgttttaagatcttattttctaagatacattcctctgccgattcatgatcattaacagcgtatcttgcaccgctatgcaataaaccatgattacgtcctgttgcacctgtggcaatgtcataacgctctaataatatgcagtcaatcccacgtagtgcacagtctcgtgcaataccggctcctgttgccccaccgccgataataatgacatcagcactgagcggtggaaaatctttagaaaatttttgagacgacattgacataatcatcccccacattgaatgtaaaaaattactattagaaagtgattatataatacgttaaatgttcgttttagaaaataaaatgagtgatttcttatcaaataatgtgattaagatcactttattagtttcgatttgaattttttttgtgtttttttgtgatttacatcacaacataaattaaattagctttttagatttcactttttggttattatatgagtgaacgttcaaaaaagtgcatttatcgctcctaattttttatacataagattggtttgataattgctatattttaatctaactaaactactggagatttattatgtttggtccatttaagcccgcaccgtatattgaggagctatcaaaagatagaatcgatccaacttatagacggttgcgttggcaagtattcatgggaatatttttcggttatgcggcttattatttcgttcgtgctaactttgacctagctcaaaaagggttaattgaagccggtttatacaataaagcggagttgggaattatcggtacgggagcaggtttggcatatggattgtcaaaatttgtgatggcaggtatatctgatcgctcaaatccgaaagttttcttgcctttcggtttattattgtcagggttatgtatgacaatgatgggcttaatgccttgggcaacctccggtattgctgttatgtttgtgatgatattcttaaatggctggtttcagggaatgggatggcctccatgtggtcgtacaatggttcactggtggtctaaatccgaacgtggaacaatcgtttctatttggaactgtgcacataatatcggaggtatggtaccgggattaatggtattgttggcaagtgcgatttatttcagcgagtttggagtacaggcaactgcaaaagatatttggcaacaagccttatattatccaggtattgccgctatgatttgtgcaattccggtctattttgtgatgaaagatacaccacaatcttgcggattacctgcaattgaaaaatggcgtaatgattatcctgatgactataatgaaaaaacctatgaaaacaatttaacaacaaaagagatctttgttacttatgttctaaaaaacaaattgttgtggtatatcgctattgcaaacgtatttgtgtacctcattcgttatggagtgttgaaatggtcccctgtatatttaggagaagtaaaacattttaatattaagggtactgcttgggcatacactatttatgagttagctgcggtaccgggtacattattatgtggttgggtttccgacaaagtatttaaaggtaaacgtggtttaaccggtttcattttcatgattttaactactattgcagtggtagcattatggatgaacccagcaacaccagaacatgaattagcacagtatgcaggaaaagcgtggtatcaaaatccatatcaattaactgacttcattttaatgacaacagttgggttcttaatttacggaccggtaatgttgatcggattacatgcacttgaacttgcaccgaaaaaagcagcaggcacatcagcaggtttcacagggttattcggttatctcggtggtacagtatccgcttcagccgttgtaggttgggctgcagaatactacggctgggacggtggcttctacgtcatgataactggtggtattttagccatcctgttaatgtttatcaccatgatagaagaaggtaaacataaagcaaaactagacgatcattacggtaaataatcgttaaaaaggaaagacaggaaactgtccttcctttttctttattaggtttatgtattcaaattttaaccacatttttatcacagattttacttctgcttaaggaaaatacaatgaaattagctacccctctttgtgcaattgctttagtagctgcaacactatcaggttgttctgcacaatttgaaaacaacgttaaccaaaaagataaaattatcattgctcaccgtggagcaagcggttatttacctgagcatacgttagaaagtaaagcacttgcttttggccaacacgctgattatctagaacaagatcttgcaatgaccaaagataatcatctcatcgtcattcatgatcattttttagatggtttaacagatgtggcgaaaaagtttccacatcgtcatagaaaagatggacgttattatgtagtagattttacgctgaaagaaattcaatcattagaaatgacggaaaattttagtctgaaagacggaaaacaggttcaggtttacccaaatagattcccgctttggcaatctcatttccgtattcatacttttgaagatgaattagaatttattcaaggtcttgaaaaatcaactggtcaaaaaatcggtatctatcccgaaattaaagcaccttggttacatcatcaagaaggcaaagatattgctttagcaacattaaaagttttgaaaaaatacggttatacgaaaaaagatgacttagtctatttacaaacttttgattttaatgagctaaaacgaattaaaacagaattgttgcctaaactaggtatggatgtaaaacttgttcaattagtggcttattctgattggggtgaaacacaagaaaaaaatgctcaaggcaagtgggttaattacgattatgattggatgtttaaaccgggtgcggtagaaaaaattgcaaaatatgctgatggtataggccctggctggtacatgatgatcgatcaagaaaaatctaaaccgaatgccgtcgcttatactccattagcagaagaattggcaaaatataaattagaggtacatccttataccgttcgcaaagatgctttacctgacttttttgataatgtagatcaaatgtatgatgctctatttaaaggcggtgcaacgggagtatttactgatttccctgatacaggtgtaaattacttaaaaacccataaataattcgacattaatatctgtcattcttttaaatgaatgacagatttttgttcttgttgtaaataaccatttctccattatcctagcctttcaacctcaacctccccctacgatatttcgtgcgtaaaagtgcggttattttatccggtgtttttattgcaatagaattagcaatctgtaatgagttatgaatagaatttgcatgggtaatggcaattgccaacgcatctgctgcatcaacctgcggtttatcggaaagttgtaataaccgaaccaccatttcctgtacctgtgatttttcagccgcacctgttccaacgaccgtttgtttaatcgttctaggtgaatattcaaatacgggtaaattttgattgactgcggcaactatcgcagttcctcttgcttgccccaattttagagcagaatcaggatttttcgccataaaaacctgttcaatggcaaattcattgggattgaattgcgtaataatttctgttattccggcataaattcgttttaatctagttggtaaatcatctattgaggtacgaataacgccacttcccaaatattctagcttatgcccaacttgacgaacaacaccatatccggttactcgagatcccggatctattcctaaaataatagacatcctattttccaaaaaataaatgaacctcatttgagatccatttaatatagactaaaaattattttgcaagtttaagagattgagctgatgaaacgtttttcatcatgcctctcaactaatttcataaatgttcccgatagaaaaaatgaagctaacttttaaagtaaagcagcaacctcatcacttatctcgccattatgataaacgttttgtacatcatcacaatcttccagcatatcgatcagtcttaacaatttaggtgcggtttctgcatccaaatcaaccattgtggaaggtatcattgttacttcagcattaacaactttaaatccggctacttcaataccgtctttcactaagcctaaatcttcccatgctgtgtaaatttcaacactaccgtcttcttgtacttgaatatcatcagcacccgcttcaatggctgcctctgtcaaggcatcctcgtcagcagactcaactaaaattagcccttttttactaaataaataccctactgagccttctgttcccaaattaccaccgcactttgtaaaacttggtcgtacttgagaaatggtgcggttagcattatcgctgagacactcaaccatcactgcagtcccgcccggaccatagccctcataaattctagtttccatattggtgccatcaccaccgcctacaccacgctcaatagcacggttgatagtatctcgtgtcatattgttagataaagctttatctactgcggcacgtaaacgagggttagcaccaacatctccgcctcctaattttgccgctgttactaattcacgaattaatttagtaaaaattttaccacgttgtgcatcttgtgctgctttacgatgtttaatattggcccacttactatgtcctgccattttatattccttttatgattgtacttttatattcattaatcgcctctgcattgttgggcgatttagtcaatttaattgcgtcctgtaccgaacaccattgataagctgaatgttcacttaaatttattactctttcatcagctaacggcaacaaaaaccaatgctcaatgcagtgagttatatcaggcgcatatttatacctaaaatgcggaaaaatttcaaactctatctgtttatggcaattaaagagcggtaagttttccgcaagaatatctatgctggtttcttccctcacttctcggattgctgtttgaacaggtgtttcacctatttccatcgtaccggttacggattgccaaaattccgaatcgtcttgacgttgcagcattaaaacacggttgcttttcttggcataaataacgaccaaaatactgttgggatttttatagttcatttggattaccttcttaaagtcatcatcactcacattaaccaaaataatgttaaatgaaaaaacaacaattgatctgccccaaaatctcttaataaatcaaaatattaaaacatcattaataattaagatagtattttaaatttcgtatcattgctacatagtaccgacttttttagcaaatttttctgcctttttcttttcttctaattctttttgttgttgctctgcacgtttacgacgaatttctttcggatccgccaataatgggcgataaatttcaatacgatcaccttcattcactatatccgttaattttgccgggcgactgaaaatgccgactttattttcacgtaaatcaatttccgtaaattcctgcaaaataccagattggaaaatggctgcttgaatgattgtccccttctcaacttgaagttttttcaaataatatttatgcggtaacgcataagtaatttctatattaatcaagataaacgtcctttgctcgttgtttaaacgcttcgatcattttcgttgtcaattgtgaaaaaatccgcccgaaagcaaaagcaataacagggttggaaaattcaaactccaattgcaacgcaatttcacaactttgctcatcaatttcacgaaaaacccatttaccctgcagatatttgaaaggtccggaagctaactgcatcgtaatctcttggttgggaattaattgatttttagtcgcaaaaacctgtttgataccggctgtactaatggttaattctccgatcgtttcattgtctatcgactgcaatgcttttgccgcaatgcaatggggtaaaaattgtggataactttcgtaatcattaacaatatcgtacatttgtttagcactataagacactaaagctcgctgatttatacttggcataaaataagatgttgaacaaaaaatgttgcaattatagcggaaaagtgcggtagaaataagagacaaaatagaaaagaatgattcatacaacaagcagttaatgtcgttgctttctaattgagcatacatcaattttccgctacaatagcccactatttttagcgaacaaaaataccaatgtcagaaattaaattaattgtaggtttaggcaatccgggcgataaatacgccgatactcgtcataatgcaggagaatggttaattgaacgtttggcaagacgctttaacttcaatctctctgttgaatccaaattttcaggaaaaacggcaagagcggtcattagtggtcaagaaatgcgttttcttgttcctaccacttttatgaatttaagtggcaaagcagtaagtgctttagctaatttttatcgtattccgccggaacaaattttagtgcttcatgatgaattggatttttccccgggcatcgctaaaattaagcaaggcggaggacatggcggacataacggtttgaaagatattattgctcaactagcgaataataaaaatttctatcgattacgcataggtattggtcatccgggtgataaaaatttagttgcgtcttacgttcttaataagccatctcccacagatcggcaattaattgaccgctctttagaggaggcgacggattgtattgaaatcctcatgaaagagggaataactaaagcaacaaatagactgaatgcttttaaagcataaacaaaattcaccaatctttgggctgaaataactcttctactctactaataaaaaataggaaaatttatgggatttaaatgtggtattgtcggtttacctaatgtaggaaaatccactcttttcaatgcgttaactaaagcaggtatcgaagcggcaaactatccgttttgtactattgaaccgaatacgggcgttgtaccgatgcccgatcctcgtcttgatgcactggcagacattgttaagcctgagcgtatactaccgaccacaatggaatttgtggacattgcgggattagttgccggtgccagtaaaggtgaaggtttagggaataaattcttggcaaatattcgggaaacggatgctattggtcatgttgtgcgttgttttgagaacgatgatattgttcatgttgccggtaaaattgatccgttagatgatattgaaacaattaatactgaattagctttagcagacttagatagctgtgaacgagctattcaacgcttgcaaaagcgtgcaaaaggtggcgataaagaggcaaaatttgagttgtcggtcatggaaaaaattctacctgtactggaaaatgcaggtatgattcgttctttggatttagataaagacgaattacatgccattaaaagctacaacttcttaactttaaagccaactatgtatattgctaatgtgaatgaagatggctttgaaaataatccatatctcgacaaagtgcgtgagtttgctacaaaagaaggttctgttgtggtaccagtttgtgctgcaattgaagcggaaattgctgaattggatgatgatgaaaaaactgattttttacaagatctcggtattgaagaacccggtttaaatcgtgttattcgtgcaggctatgcgttattaaatttacaaacctacttcaccgccggtgtaaaagaagtgcgagcttggacagtttccgtcggtgcaacggcacccaaagcggcagccgttattcatacagattttgaaaaaggctttattcgagcagaagtcatcgcttatgatgattttattcaatataagggcgaggcaggtgcaaaagaagccggtaaatggcgtttggaaggtaaagattatattgtgcaagatggcgacgtaatgcacttccgttttaatgtttaatattcacaactaattttataccgcatttttcaagttgaataataaaagtgcggtattgtttatggagtaaaataaaatcgcattttattatccagttttccattaaagtttttaactgggagaggtttgttgattttgaagatttagcagatgatcctgcgagaagacaataaccgaatgaatgatctttagtgtggcttgtgtcataataggcatcgttttttcagcgacttagaggagaatgattacatgagaattttacatactatgttacgtgtgggcgatatggatcgctcgatccacttttatcaacaggtattaggcatgcgtttattgcgtacaagcgaaaacactgaatataaatattctttagcttttttaggctatgatgatgaagaaaactcatctgttattgagctaacttataactggggtgtaagtaaatatgaaatggggactgcttatggtcacattgctattggagttgaagatatttatgccacttgtaaagcggttaaagaagcaggtgggaaaattactcgtgagcctggtccagtaaaaggcggaaaaactgtcatcgcatttgtggaagatcctgatggctataaaattgagtttattgaaaataaaatggcacaagcagggctaggtaatcaataacctcaacaatttttatcctaaaaaatgggctttttatctgcctattttaagtattacatttatctcattcttataaggtaatatttcgtgaccgcactttcagaacaagcagtggattataatttacttaaaaatcgctttcggggtttttttcctgtcattattgatgtggagacagcaggctttaatgctcaaacagatgccttgctggagctagctgcactcacactgaaaatggatgaaaacggtctattagtaccggatgaaaaatgccattttcatattcaaccgttcgaaggggctaatattaatcctgaatcactcaaatttaatggtattgatatagacaatccgttgcgtggtgctatatcagaaaatgttgctatgagtgaattgtttaaaatggtgcgtcatgggcaaaaaaaggctgactgtcaacgttcagttatcgtggctcataatgcgacatttgatcaaagttttgttatggcagcagcagaacgtacgaaaataaaacgcaatccgtttcatcctttttcgatatttgataccgcaacgttaagcggttttatgttcggacaaacagtgttggtcaaaggttgtcaggttgccaatatttcttttgatggaaaaaaagcacattctgctttatatgatgcggaacgaacagctgaacttttttgttatatggtaaatcatttaaaaaaactgggcggttttccccatgtggcaataaactcataaaaaacggtgctaacaaagcaccgctcttttgcgttactcattattcaaattactgtacaacaatactccctaaacaaccttgatcagctaacactaaatcagatgaaccgaaaataaaagggaatttagtagaggacgcatgattaaattgcactaaaatttctaccttgccgtcaatccaaagactatctttccatgcaatatccgattgttctaccggctgatcatttatgcttttcatgacaaaacgagcaccttgaattttaaatccgacgggccttgaagaacttagaatccagcgttctatctgccctcttttggtactaatatctattctattcggttcaaaccgttgttgattaatggttgcattgctcacatcaaaataaaactctctcgttttcatatttttctttgccaataaactaggtgcatcagtatgaaattgccaatgacttggattataaaatactgatttaaccccctctgttctcaactcaacaataacattatcaaccagcatatcagaactgaatattgtacctatcttattcaaaagatttcttttactaccagtaattaaggtagcatttccgccctcacttaagtcaaccaataattcaaccctttcactaggtgcaagagaaacttttttgacaatttttgtttgtggcaaataaccttgttctctggcaatcaagaaaaatgcccgctcatcatcaaatgttaaatcataagaacgagataaagaggcattcaacaaacgtaaacgtaccaatcctttaggtacattcaaataaggtgcttcaacaccattgaccaataaccgctcgcctagaaagtgcggttgattttgaaatacttgctctcccttagaatttaacagtacatcttgcaaaataagtggaatatcatcaacgccatatttttttggcagtttagattgatgagtatctttgtcatttataatccacatgccaactaagccacgatacgtttgatacgctgaattagctaaagtgcaggcatgataaaaacaagttgatgccggttgagtaataggtaaaattggagcccatccttcccctgccatcaatactcgcccaataccaccaattaattcactgtgtgcttgtaaaccttgtatattcatagcaactgcctgcgttaaattattacgataatttaacttcacaaaatcaccttgctcaactcttacggtaggacctaaatgatgcccattaaatccccaaacttccgttagctttttttctatgaatgaagtttgagcagcttgcatcgttaaaaatatcggtcgcccacgttttgcctccaataacggtggaataaataaaggcaaacggctagcagccattactgattgagggatacatgataaagaaccggctaaaataccgcttttcaaaaaatcccgtcgagtcaaagatctcatattttaccttgctgcttatacagattgctgttgaatttctgcatcaagctctgcgatgcgttgttgcataatttgatgacaatattcagctaattcccgtacattatcctttgtgtagtttgatgtatctacaggagacatcatttcacaaatcactttaccattgtcccaccgatttaggtcaatgcgattatgggtggttgaacaaacgaccggaacaattggcacaccagcggtaattgccgcataaaaagcccccattttaaaaggtaataatccacgcccacgactacgtgtcccctcaggaaacatccaaactgacaaattatcttcatttatacgacgagcaagttggtttattgtattatgggctttggagcgattttctctgtctaacaaaatatttcccgttgcccaataaagaagaccaaaaaagggaatccaaaccaaacttttcttgcctacactgactgtacgagggcgaaccatagcagaaacagtcaccatatcataattattttggtgattaccaatatagatgcacctaccgatactatcgacattttcaggaaaacgatgttcaacttttaatccaaaaaaaggatataaacgcccaaaccagcgagccatcacacctacattacttggatttttaaaacgaataagtgaataaagagatcctactacacaaattaaaatactacagaagataacaacgatggctcttaataatatcaacataaatatacccctaaaaatttgtatacgccaagtataacgaaaatctaaaaataagtgtagaaaagcataaaaaagtgctaggctagcacaaatattttaggaacctcagcatgaaaaaaacattctttattgcagatttacatttaagcgaaaaccgaccgcatttaactgaactctttgttcattttatgcaaacgcaagcactacaagcagaaaagctttatattttaggcgacttatttgatttttggattggtgatgatgaacaatcagccttgatcgaaacagttcaacaacaaatattacagctcagccaaaaaggtattccttgttattttattcatggaaaccgtgattttttggtgggaagacattttgccaacagttgcggaatggagttattaccaacctatcagatcgttaatttatatggtaaaaaagtacttatttgccatggtgatacgctatgtactgacgatcttgattaccaacaatatcgcaaaaaagtacaacaaaaatggctgcaatggctatttcttcacttacctttaaaagtgcggttaaaaattgcagaaaaaattcgccaaaaaagcaaaacggataaaacacataaaagtattgaaataatggacgtcaacaaggattttgtagaacagattatgcaacagtttcaggtcaacattttgattcatggacatacgcacaagcagaatattcatcaaaatccaccgcactttactcgcatagttttaggtgattggggagcaacagcttctgttttagaggtttcagccaatgggtttcagtttatctaattcgtcaggcacaaaacctaaacataaagaaaaagagatcaaaatatgccctttttccatcacaactaaattttttccaatttggctaaatgagcgactagccatttaatcccttgtccctgaaaagcgatttgcaatcgggtattattatcagccccctcaacattaatcactgttccctgaccaaatttttcatgtttcaccttttgtccaactttccaactattatccgataaatcagttttgacgatagaacccactgcacttcggttataagctcgagtcactgtgccacgtaaacgaacttcttgaatacattcttgcggtaattcagcaataaaacgagaaggaatatgtttttcgtctttaccatacaagcggcgaacttccgcataacacaatgtcaatttctgttttgctcgagtaatccctacataagctaaacggcgttcctcctccaaacgtgccaagtcttcacccgaacgaaaacttgggaaaagcccctcttccataccaacaataaatactcttggaaattctaagcctttcgctgaatgcaatgtcatcatttgcacacaaggctggtgagagtctgcttgttcttctcctgcttccaaagaggcatgtgttaaaaacgccactaaatcagacatatcttcagcctcatccggttttataaattctctcgttgcggtaaccaactcctccaaattttcaattcgcacttcccctttgtcccccttttcctgtttatacatgtcatataaaccggaatgtttaatcacaaaatcagtttgtacaaataggggcatttctgcggtttcttgttgtaaggaattgattaattcaataaaacgtaacaaaacagttaccgaacggataggaattaaattttcttgaatggcaagctgagttgcttgccataaagtcacttgtctttcacgagttaaattacgcaaaatatctaaagtacgctcaccaatacctcgtggtggcgtatttacaacacgttcaaaagccgcatcatcttgtcgattggcaattaaacgcaaatacgctaaagcatctttaatctcttgtcgttcaaaaaatcgcataccgccataaatgcgataaggaattttagcccttagaaatgcctcttcaatgacacgggactggctattactacgatataaaactgcacaatcatcaaccttaccgccgttatccagccaattttgtacctgaccggagacaaacaaagcctcatccaactcgttaaaagccgcataaatccccacaggatctcctttttcacccgcagtccaaagatctttacctaaccggttactattattggaaattaaacggtttgcactttctaaaatgttgccggttgaacgataattttgctctaaacgaataattttcgcttttgcaaaatctttaagaaaacgatgaatattctcaacttgagcaccacgccaaccataaatagactgatcgtcatctccgacaatcatcacattgccttgcgaaccggctaataatttaatccaagcatattgaattttattagtatcctgaaattcatcgatcaaaacgtgctgaaaacgctgttgataatattgcaaaatatgtggattttttagccacaattcataagctctcaataataattcagcaaaatctactagacctgatcgatcacaagcatcttgataaattttatagatcttgatccactctcgctcttgacgatcattattatcttcaatctgatgagggcgtaatccttcttcttttttattattgatataccaacaagcttgtttatagggaaaggctttttcatcatattgatgcaatttcatcaaacgcttaactaagcgaagttgatcttcactgtctaaaatttgaaaatcctgtggcaatccggcatctgcgtaatgggatcgcaataagcgatttgcaatgctatgaaaagtgccaatccacataccgaataaacgttgatgggaataacgagctaaagtcgcctcaatacgatgacgcatttccgtcgctgctttattggtaaaagttaccgccataatacttgattcaggtattttttctaccgcacttaaccaagcaatacgatacgttaatactcgagtttttccgcttccagcaccagcaagtacgagataattccccaaaggtgcaacaacagcattgcgttgtttttcattaagatcattaagtaattctgaaatatccattgtcgcccataaactgtgtttttatacagttgattatattgttttaaccggaaaaagcaagataagaatcaccgaataaatgctgaagcatatttcgccaactttccttcccaaatttccaatccatttaaatatcaaacaaatttcctacataagtcgaatataaacggttatttcttctctatcatgataaagatgttttgcttgtatttggaaagatatatgttgttcatttagtctttctttaatttgttgtaaacaccgcttaacctcaaaataacgctttttcataggtaattttaagttaaaaatagtttccttacaccaacctttgacgagccattgactgattaaatcagcaattctacgtggctgttcaaccatatcgcaaaccagccagtcaattttacaatgcttaggaggccgaaatttaaagccatcttcagcacaatgttcaattctgccggtctcatgtagacttgttgccattttgccatgatccactgcatacacaaaaacacctcgtctaaccaattgataagtccaccctcccggacaagcccctaaatcaacagcatatttattttcgttaaaacgtgttgcttcttgattgcggggaataaaataaagaattgcctcttctaattttaatgttgaacgactaggcgcttctgccggaaattttagtcgtggaatccccataatatgttcagcatggttattgttataggaatagccaatgtaacaactgttggattgagtgaaaaaaatatgcagagtaataccgctctttttgttttttgcttgtagccagccttgctttctgagagcttgtctaagcggtacagtaaattttcgacaaaaagcggccagtgttttagcttcattggtatcggcggtttctacccaaatatcactactctgtttgagattgaggattttttcttgttgacgataatattcaataatcggactgatacgatcttgcacggaaagattactaataagatcagatacgacaatcatttgtcgagcaaaaatcagttgactaaatgtaatctttctagcgaggagatccgcctcaccgatttggtaacattcaaaaataacatagcctgaattttctactactctggcaaagccaaaaacaccaagtgcggtggctttttcggttatttccgccgccaattctttttcaaagccgctacggcaatataacgctaatttattcatgtttattttgcttcattgcatgcacaatccattgacggaatgcgttaatttgttctgtattggttcgattaagagaatttaccacataaaaagattttggatcaggtagagagatagataacacaacttgtaagtttccgttctctatttcgtgttgagcaagaattttatttgccaacacaataccttgtccatgcacagcggcttgtaatgccataaatgtatgactaaataccggtccatgtcgaatatctaatttatccagttgaagtaaattcgccatattacgccagttatctctagtatgaacatgaataagattatggtgatacaaatctgttgcttgcgtaacaggttgtttagcgagtaatttaggggaagccaaaatcaacaattttgcctctgccaatttttcaacttgtaatcccacccaatttcctttgccataataaatggcaatatcaatttcattactcaaaggtatttcgtcttgatcaaccccttttaatctcacctcaatatccggatatcgttgattaaattcacttaattttggtacaagccattgcataccaaaagtttgcggaacgctaattgaaagatattgctcatttttctgagccattaattttgttgtagcatcggctaaattatttagaattttgctgacatcggaaaaataagcccgacccaaatcggttaattctaatgttctatttttacgcttaaataatataacacctaaaaaatcttctaataattttatttgatggctaactgcagcctgtgtaacaaaaagttcatctgcggctttagtaaaacttaaatgccttgctgaactttcaaaagatttcaatgaatttaaaggaggcaaacgtttaatcatcattcttcccaattgtattgtttaaattataacggttgaaattgctatcagattagtttttctaataccatatataaaaaaatatatcttgtctgacctatccattctccatagaatgcacgcatacttaacgattggtaattccttactggttaaagagtttcggacttaagtatgatgttgtgtttgcatattgttcgggaaaccgaaccgagtaacaaattttaagttactcatttacttcctgtatgtatatttaaaccgttttttaggttatgtaccgctctttatgagcggtatttttttatgggcaaaattctatcataaaatttcccatctctatcattccgagcgataaaaatccctttatattttaaatatccagtttccaacctgatgagaatagtgtagattaaattcactattttataaacatcaagaaggaagtaaaaatgaataaaaatattgattgggaaaatctcggttttagttatatcaaaacagattatcgttacattgcttattggaaaaatggagcatggtcaaaaggtgaattgacacaagataatgttttgcatatcagtgaaggttcaaccgcactccattacggtcaacaatgttttgagggcttaaaagcctatcgttgcaaagacggctcaattaacttatttcgccctgaacaaaatgcactacgcatgcaaaaaagttgccaacgcttgttgatgcccgaaattccggtggaaatgtttgtcgatgcctgtaaacaagtcgtcaaagcaaatgcagattggctaggtccttacggttccggtgcaacactttacttacgcccatttttaatcggtgttggtgataatatcggggttagtccggctcctgaatatatattctcaatcttttgttgtcctgttggtgcatactttaaaggcggtatgaaaccgactaactttatcgtttctgactatgatcgtgccgcaccacaaggcactggagcggcaaaagtggggggaaattatgccgccagtctttatccggggaaaatggcgaaaacacgtcattttgcagattgtatttatcttgatccgactacacacaaaaaaatagaagaagtcggttctgcaaacttcttcggtataactaaagacaataaatttattactccattatcgccgtcaattttgccaagcattactaaatattctctactctatctagcaaaagagcggttaggaatggaagtgattgagggcgatgtttatattgatcaattagatcaatttaaagaagccggtgcatgtggaacagcggcagtcatcacgcctatcggtggtattcaatatggcgatcatttccatgttttttattctgaaactgatgtaggtgaaataacaacaaagctttataatgagctggtcggtattcagtttggtgatgttgacgcaccagaaggctggattgttaaagtagaataataaaaaatacacaactaatctgcaatttaatcaagtaactttccgatgaaattgcagattttttctgacataaaaatatcttaacgttgttccaatgaatttaaataatccaagacaatttgatgatgatccgtagttttaaatttatcaaaaactttttcaatttttccctgttcatcaattaaaaaactaatgcgatgaataccatcaaaggttcttcccataaactttttttctccccaaacaccgaattgttctgccacaatatgttgctcatctgaaagaagatcaaaattcaatgctttcttttctataaaattggctaattttttcggcgaatccggactaattcctaagataacaacccctttattttctagctccgctttgctatcacgcaacccacaggcttgcgttgtacaaccaggcgtcaacgcttttggataaaaatagaccaatacttttttcccgtgaaaattctcaagactcacctgttcattattttgatttaatagactgaagtgcggtgcaaaatcgccggcttttaatgttttcataaaatattaccttttaaaaaatataaaaaaatacttgcaaagtgttgccattttaacgatcctaaacggactttttcaagctaatatgcaaacataataaggagattttatgaccacacacagacctttattctacggcagtatcaccgcacttattacgccaatggatgatcatggggaagttgattttaacgcattaaaaaaactggttgaataccatattacttcaggatctcacggtatcgtttctgtcggtacaaccggagaatccgccacattaagcatcgctgaaaatgtaaaaacaattttaaaaactcttgagtttgccgatggaagaatacctgttattgcaggtaccggagcaaatgcaaccagcgaagcgattacgatgaccaagctgttaaatgatagtggtgttgcaggttgtttatccgttgtaccttactacaataaaccaactcaagaaggtatgtatcaacattttaaagccattgcagaatgtacggatattccgcaaattctttacaatgttcctagccgtacaggtagtgatttattgcctgaaaccgttggtcgtttagctcaaattgcaaatattgttggaattaaagaagcaacaggtgatgtcagtcgtgtagcgaaaattaaacagatggcgggggaagatttcattttcctcagcggcgatgacgcaacagggcttgaaagtatgaaacttggcggtcaaggagtcatttccgtcacaaataatattgccgccgctgatatggcaaaaatgtgtgaattggcattagccggaaaatttgatgaagcagaaatcattaatgataaattaagagctttacataaagatttattcatcgaatcaaatcctattccggtaaaatgggcagcttataaattaggattagtccctgatccgatattacgtttgccgctgacaactttaagcgaacaatcgcaaccgaaagttattgaagcattaaaaaatgccggattgctatagtcttcttactaaacattagggtctgcaaacgaccctattttttaaccgatttctaggttaagtgcggttgttttgaagggcaaaataaattttatttttttctgaaggtttgtattgtataattcgtcacctaatgtcatgcgtacaatctacgcttatctttttacaaaataaggactttttatgaaatacaaactgtcgttagcgttattatttacgcttccagcctttgcccatgcggggggggtaattttaatttttatggcaaggcggggattgatttaacgtctcgttttgaaacgatgaaaataatattaaattacaataaagaggtaacaaatgttcctgcaagttcaagacaaaacaccttctcaccaagtatctttcttgaaaccacctacaatattttaccacaaacagaaatcggtctcggactaggctatattaaacgcaaaggctttgatcattctgctacttggaagatcacacctgaaggtaattacggaattggtggtgataacaatgcagtggaaaactatagaataaatcgttattcctccctaccaatttatttcacgttgaaacaaaattatgcgttaaatgcaaacagcaaattttatctaaaaggggatataggttattcaatcaacaaaattgataacacaaaatataattactatacagatgtagatcataaaactacaacgactaatcgcaatatgaaagctcaaaacggtctatatttaggtttaggcattggatttgaatataagtttttcttagcagatattggatattatcatactcatgcaaaagttaattataaaagcgacggaagctattcatggcacccttacaacaacgatgctatacgtttaacgcttggatttaaattctaaacaacacaaaacagaataaatctttaagctaaacttttaccataaaaatccctattgaaatattattcagtagggattttaatattttcaatcggttaaatctttacaaaaacgctacatcataccnnnataaaatgccattaccaccgcactttcccgttttccgtcaggtaaaggataataatttttacgaatatccacctcattaaatcccaaattgtgatatagctgtcttgccttaatgttcgtttctctcacctcaagccataaggtttgtatattacgttctaataattgttgaattaattctttcagtaattcttttcctaaccccaatccttgataatcaggatcgacggcaatattaaacaacgttgcctcatctaacacaagataacaaatggcaaacgcaacaatttttccattaaccactttctttaaattaagataatgttcgccttgattattttttaatgtgcctaatgaccaaggaacaatatgtgctttttgttcgatcgcaaataattcggcaaaatcttgttcatcaatatatgaaatcattttctatatttcctgaatttgctgccaaaactgacgtttttcctgaggactttgctttaatctctcaagttcattacttttccaacaaggcatatattgcttatcgcttaaagtgcggtctattttctgttgatcgtttgtgagtaaccaataaatcacttcatgttcgacttgaagataaggcaaaaaatcaaagtcaatacataaacaatcttctttcattagctcaagactacgaaaaatatcttgtaaaaacggttgttcttttaaaaccggctgttcagaaatcataatcaaacgaatattttttgccacagagacatttaccaacccttttaaaatctcgggatggcgtaatttccactgtgaaatacccatttcttgtaagagtttatctcgtctgttcatttctattttcctaaataacaggctattttaaaccgtaaccgaaatgaggttaagcaataattgtgtccatttttagctcttggatttgatataaagtgaagaaactcaaccgtagaagatcaaacctaaataagaaatcattaaattagttttgaccttctacactccagtagaattttaattcaaactttttgttcgagaagaacgcttacgagaagatttaattttatgaattggagaaagcttcacaaaatcaactccttccggtggattttctagtgcaattgttaagacttcatcaatagtgtcaaccgcatgaatagttaaattatttttcacattttcagggatttcttccaaatctttgacattttctttgggtataatcaccgttttaataccacctcgatgagctgctaataatttttccttcaacccaccaatcggtaatactttgccacgtaaactaatttcccccgtcattgccacttcagattttaccggattaccggttaaacaagaaaccaatgctgtacacatagcaatacccgcacttggtccatctttcggagtcgcaccgtccggtacatgaatgtgaatatcacgtttttcatgaaagtcattagcaatacctaacttttcagctcgagttcttacaacagtcatcgcagcttgaatactttctttcatcacatcgcccaaagaaccggtataaatcaatttacctttaccgattacagatgccgtttctattgttaataaatcaccgccaacttcggtccaagctaatcctgtcacttcaccaatgcggttttgtgtatctgctcgaccaaattcaaagcgtctaaccccaagatactcttgcaaattgttagaattcacttgaatagatttcaaacttttatctaatagcagatttttcactgctttgcggcaaattttagaaatctctctctctaaagaacgaacaccggcttctcgagtataatagcgaataatatctaaaatagcctcttcattgataaccaactcatcagtcttcaatccgttacgctcaatttgtttattcaataagtgacgtgtcgcaatattgagtttttcatcttccgtataaccggagagacgaatgacttccatacgatccagtaaaggtgctggaatattcattgagttggacgtagcaacaaacattacatcagataaatcataatcgacttcaagataatgatcattaaaatgtgaattttgttcaggatctagcacttccaataatgcagatgctggatcacctcgataatccattgccattttgtcaatttcatcaagtaaaaacagcggattttttacccccacttttgccattttttgaattaatttgccgggtaaagaacctatatacgttttacgatgtccacgaatctctgcttcatctcgcacaccgcctaatgccatacgtacatatttacgccccgttgcattggcaatagaatgccctagcgatgtttttcccacacccggagggccaactaaacataaaatagggccttttaattgatttaagcgactttgtaccgctaaatactccaatatacgctctttaacacgttctaagccatagtgatccgcatctaaggtttcctgtgctttggcaagatcttttttaactttagttcgcttatgccaaggaacttgaaccatccagtcaatataactacgcaaaaccgttgcttcggaagacattggcgacatcatctttaatttttgcaattcggcaaacactttttcacgagcctctatcggcatcttagcctcttctattttcttgcgtaattgctcaacttcatcaactgtgttttcatcatcattcagctctttttgtaatgccttaatttgttcattcagatagtaatcacgttgatttttttctatctgttttttaactctgccacgcacacgttgttcaacttgcaatatatcggcttcgcttaccattaatcctaataaatattcaaaccgtgccgacaaatctcctatttctaggatattttgcttttcattaatagataccggaagatgagctgcaaccgtgtcacttaatctctctatatcattaatacgtcgcaatgcagaaataatatctgcgggaatttttttatttaaattcgcatatttttcaaattcggataaagtaattttcttcaatacacttaattctttctcatcactccattgtgtttcaattaattcgtgagacgctaaaaagaattccccattatcttgcaaatcaataagtttagttctttgttgtccttcaacaagaacttttacagtaccatccggcaattttaacaattgaataatattgactaatgtaccaatcttataaagatcagcgatcttaggttcttcaatgtcaggttttctttgtgaaaccaataataattgcttattattttccatcgcctcctctaaactacgaatagacttgggacgaccaacaaacaatggcatgaccatataaggaaaaactaccacatcacgcaatggtagaaccggaagatgctctagcttagttcgttttgcgttcatataatttactctctttcttaaaaatagactgaatgcacaggatatgggggctttttgttaaagttcaagcgaaacccaacctgctaaaacaatcaacatcattctatctaaaatgctacaaaacattccggcactttcttttgcttatttcgaagaaaattcaagcacctgttgtacgaagagtgatgtatctttagaaataaaaatctgcaccttaatcagttgtttatttactccaacttttagtgtgcagatcattttcaagtgcggtgtgtttttataaggattttactttttagggtgatccataaaacggaagaaatcactacccggttttaaaatcatcatattattcgaaccttcaaagctgttttcataggctttcatactacgcataaaactgaaaaactccggttcttgagcaaacgcatctgaatataattttgctgctgttgcatcgccttcacctcgcaactcttgtgcctttttacttgctgttgccaaaataaccacaactttacgatcaacatcagcttgaataaatgcggctttttctttaccttgtgaacgatgttcacgagccactgcatcacgttcagcacgcatacgttgataaattgaagaagatacttcatcaggtaaattgatctgttttacacgaacatctacgacttcaatacccaattcagcagtactatcttgtcctgtattcaatgctttcttcgcatcttccattaattcaccacgagtaccggatacaatgtctttaatagttctggagccaatttcagaacgcaaacgatcatttactttacggcgtaaaagattcgaggcttgtacataatctccgccactagtggctgtataaaagcgaccgaaatcactaattctccatttaacataagaatcaactaatagatcctttttctctacagtcacaaaacgatcaggttgaccgtctaaagttctaatgcgagcatcaaggattttgacgtgatcaataaatgggattttaaaatgcaagccagggctataaacaaccactttattatctgcatcacgatgtactttactaaaccgtagcataatgccacgagttccttcatcaataatcacaacacttgaataaatcagtgcgaccaatacgataagaataggagttaagaatttacgcattaattaaatctcccttgacgaccttctataacttgataaagactgttcggttgcgaaatttccggatttgttaccgctctttcaggaacctttttttcacttgattgatcagttttaacgagcgtattgcttttctctgctaacgttttactattcaagatctgctctaacggcaatacggttaaattatttccactctgtgtatctaacatgactttcggtgtattcgccatgactttttccatagtttgaatatacaaacgttcacgtaataattccggcgatgctttaaactcaggtaataaacgttggaaacgctctacttcaccttgtgcatccaacacaacttgttctttatatgctgtcgcctgctcaataatacgttgtgcatttccacgagcccgtggctcttgctcacgagcataagcttctgcctcacgaatatagcgttgctcatcttcttgagccttaattgcatcatcgaaagccgctttcacttcctccggagggcgagcagactggaagttcacatcaatcacttctaagcccatatcataaacagcaatgatatcatttaaagttttccaagtattttcacgtacaactgaacgtccggtagttaaaatatcatccatcgtcatatgaccaattacataacgtaatgcactatctgtcgcttgatttaaactgtcatccgctctcgttacactaaacaaatatttcgccggatcttgaacacgatattgcaccgtcatctcaaccttaaccatattttcatcttgcgttaacattgaaccctgtgttcttaactcacgaacccgctcaacattcaccgctgttacgctatcaataaacgttggtttccaatttaagcccggctgaacgattgaatgtaattgtccaaaacgaagaactacaccacgctccgcttcttttatggtataaaacccgcttaatccccaaatcaccgcaccaatcaatacacctaacggtaacaatttacctaaccccaccggagcatttggcttgccgttttttccgacattaccggatttaccactgatttttttcagcaaattattaaagatctcttcaatatccggcggtgattgttgagtattcttttgttggttattcggctgctcccaatttgactgtttatcttcattatgggattgattattttccggttttttccccgtgctacccggcttaccccaaggatcttgatctgaattattgaacgacatttcattctccatttgtcaaaaattgtgacaagtctaaacaaaatattgatctaagtctaatttatttaaaactaattttgcgatttatttggtattcctcacacaaaagcaaaaaaataactcatttttcaaaccctgtaatgataatcaccgcacttagaggtaacaacacagaatgatgaaaatcacctttcaaacgaatggataagaacaaaaaatagttatttaatagcaaaaaattcagaatgagaaagttattcagaagtgataaaaatcgccgaatgatcggcgattttgtataaaatgaatcaatctaaccgtttagacatagctaaccaatcggctttaaattcacgacgcatattattaattgcatcaataatatcatgatgcaccaattgttcgttttggataccgacacaataaccacctttgccctgtaataaaagatctacagcgtaaacccccatacgagaacctaaaatgcggtcaaaagcacaaggcgtaccgccacgttgaatatggcctaaaatagttgctcgagtttcgtgttttacacgggcttcaatttctcgagccagctcattcacatcacataataattccgtgatggcaataattgcatgacgcttacccttaataatggcacgctcaatttgcttaattaattcttcacgattaaattcaatttcagaagcaacaatatattcacaaccacctgcaatagccgccgagatcgtcaaatcgctacaatgtctgcccataatttccacgatagaaatacgcttgtgtgaacttgaggtatcacgtaaacggtcaattgcctcaactgcggtttcaagtgcggtttgataaccgatagtataatcagtgccagcaacatcattatcaattgttccgggaataccgacacaagggaaatcatgttcttcagtgagtaattttgctcccatataagaaccatctcccccgatgacgacaagtgcatcaataccatgtgaacgtaaaatttccacgcatttttcacgtacggcaggatctttaaactcagggaaacgagctgagccaaggaatgtaccgcccctgttgataatatccgatacgctatagcgagttaattgttggatcttgttgtgatataaaccgtaataaccttcataaatcccataaacttccaagccctcggataaagccgaacgaacaacaccacgtatcgcagcattcatccccggtgcatcaccgccacttgttaaaactgcaattttttttatcatattacttacctaatgtattgttaaaattaatcttcaaaaaaacagtgccaaggttacactattccttgccgtcgctctataaaaatttttgtgaattgcaacacaatttgatctagtttaaacttttcagctcaacttgaacaacgctggttggctcttgatgaatcgcaatatcagtgtcagaaaatcgctgtctcaattgattttctatatcttccgtaatttgatgagcttgaacaaaagacatatgatcatctaattctaaatgaaattggataaaacgaaccgcacctgaacgtctagttttaagatcatgaaaacccaaaatacgtttatctgctaaaataatttgttctatgcttttaatttcttcatccggtaaggcaacatctaaaagcaactggagattatcaaacaagattttacctgcattaatcaatatataaaaagcaattaaaagagcaaaaatcgcatcggcttgttggtaacctaattggctcaacgataatgaaattaaaatagtaaaattcatcaataaatccgtttgataatgaagtttatccgctttaattgccggactgcctgtttgtttaatcactttgctttgatatatcactaacaatgcagtagctaaaatcgaaaataaggttacaaaaacaccaatctgaaaattcatcaagggttgtggtgtatttaagcgatgaataccttgcagaagaataaataccgccgatccggaaataaatgcactttgccccaaaccagcaagagcctcagccttaccatgaccaaaagaatgattatgatccgccggcatcagtgcaaaacgcaaaatcagcatattcatcaaagacaccaataaatccaacattgagtcagtgatagacgctaacatactgacagaactcgtttgccaccaagcgaaacttttcactaaaattaataataaagcggtaaaaatagctaaattggctgcttttttcacttgttgggaataaatacgttccatttatacaattgccctcattgataacaaccgactattttatattgttcgagctgtgcgatttctttatccacaatatatttttttaaatagcgttcaattttacgtttactcattgctgatgtgggagctttcattaacttaaaagaatattgatattgaataaaaccacaaaaaggaacctctttaccttttgcaatatctacttgccaagttggatttttttctgtcggttcataaatcacaaagctgtaaagctcattatctttcaaataaagattaaattgcttcacaccgttattctgataaacatgtcgtctcaatgttatacgatccgacaaactacgtttttcatgattacgatcgtgtaataattcaaccgcactttgccagttttcaacagtgtgttctttcggtaaataaaagtaacgagccacagtttccaaatctaccgcactgacaagataataacttttttcatgatgcttaatatattccggtacgtttactcgagagtgtgatacacaggctgacaataaaagtgcggtcaacatagctaagattttgttcatttaattaaatctcgcttaaatacaaattccgtttgtgttgaagaggatggattaaactgatacccccctaaatcaaactcttttaattgttcaatgtcagtgactcgatgttgaataatatagcgacacatcaaccctcttgcttttttagcataaaaactgatgactttatattttcctcctttgttatcaaggaaaaccggcttgataattttcacctctaattgattttctttaatggatttataatactcatctgaagccaaattaacgagaattctatcaccctgctgttcaattgcctgttgtaatgcgtcggtgatgatatttccccaaaaagcatataaatccttgcctttttcatttgccaattttgttcccatttctaaacgataaggttgcattaaatcaagcggtcgtaacactccatataatccggataatacacgcaaatgctgttgtgcaaattgaatatcgtcccgacttaatgtttcaacctccaagccggtgtaaacatcacctttaaaagcataaattgccgcacgagaattttgttcattatgctctatttgccattgttcaaaacgtgcagcatttaaaccggcaagtttatcgctaatcgacattaacgaacttatttgtgccggtgaaagttgacgacaaatttttatcaatttttcgctatatgcagttaagtgcggttgagaaaaagcaaaattcggtaccgcactttcccaatctaacgttttggctggagaaataatagctaacatgttctttcctcaaatttatatcgtcattggcaattgccaattaatttcagttaaattgtgatgtcgtaaatactgattggttttggaaaaatgcctacaaccgaaaaatcctctatgtgccgacaatggcgaagggtgtggcgaggttaaaacacaatgcttagtgcggtcaataaattgaccttttttctgagcatgactaccccaaagcaaaaaaacaagatgatcacgttgttcatttaaaacatgaataacacgatccgtaaacgtttcccaaccaaaattcgcatgtgaatgtgctaatccctgttcaacggtcaacaccgtattgagcaataatacgccttgctttgcccaaccgaccaaatagccatgtgaaggagtttgaaaccccataatatctgttgagagttctttataaatatttaccaatgaaggaggcggtgctatgccgggtttgactgaaaatgccaacccatgtgcttgattgacaccatggtaaggatcttgacctagaatgacgaccctaacctgatcaaactccgtcaatctaaaggcactaaatacttcttcttgaggtggataaattgttctaccgctttgtctggcttgttgaacttgctgtaaaatatgctggaaataaggttgttgtttttcttgcccaattgcctctttccacgtattcatgattttcctcatattgatatgccaatcttaagcggcaattataaagaaagaataataaaatgcctagtttggatttgcttaatacgtataggttatttttaaattttgctaaatttaacgccttgattacgtttcaatccaatatattttttcaataaaattaaaccgctctatatcaaattaattgaaaatataaaattttttgataaaatttgcaccagttcaattcgtgaaaaaacataatgattaggagcatattatgattaaaggtatccaaattactcaagcggcaaatgacaatttattaaactcgttttggttattggacagtgaaaaaggcgaagctcgttgcttagcggctaaagcggaattcgttgaagatcaaatcgtggcagtaagcgagttaggtcaaatcgaatatcgtgaattaccggttgacgttgcaccaacaattaaagttgaagggggtcaacacttaaatgtgaacgtattacgtcgtgaaacattggaagacgcagtaaataatccggaaaaatacccacaattaaccattcgtgtttccggttacgcagttcgttttaactctttaacaccggaacagcaacgtgatgtaattactcgtactttcacacaaagtttataatttccatctgatctgatgtgccgtattcccacatactttaaaacgtggaaatacggcacaaaatattctcgtcgactttgctctccgagcttaccttattttttattgcaacaccgaaatgtctgctacttgtaaaaagagattttgtagcgtgcttaaaatcgctaagcgattttggcgaagcgtttgttcttccacatttaccattactccgtcaaaaaacgcatcaatcggctgacgtaaattcgctaatttatccaatacagccgtgtagtcgccttgtgcaattaacggttgcacttcgccttttaaggcaataaccgcttccgccaacgttttttctgccgactctacgcaaacgcctaaatcaatctcaccaatcgcaatatcggctttcgctagaatgttgctcacacgtttatttgcggcggctaaggcttcggcactgtctaatgtacggaaatgagaaaccgcacgcacacgagcatcgaagtccgcaggtttggtcggacggcgagccaatacagattgaatgacgtctactgcaatgccttcactttcataccatgcacggaagcggccaagcataaagtctactacttcatcaaccacatttttattcgtcagtttgtcgccaaaaagtgcggtcgcttttgccacaatgtcagctaaatccaacggcaagtttttctccacaataattcgcagacaacccagtgcggcacgacgtaaagcaaacgggtcggcactgcctttcggggattgtccaataccgaaaatccctgtgagcgtatcaattttatccgccaatgcaacagaacaagcaactaacgaattcggcaatgtatcaccggcaaaacgtggcatatattgttcgttcaacgcaaccgccacgtcttcatcttcgccatcgtggcgagcatagtgcatacccattacgccttgcgtatcggtaaattcaaacaccatattggtcatcaaatcgcattttgagagcaagccggcacgtttcgctttcgtttgatccgccccgatttgtgctgcaatttcgcctgctaaggcttcaatacgagcggttttatcacgcaatgtgccaagctgttgttggaataatacggtttcaaggcgtggcaaccgatcttccaatttctgttttaagtcggttttgaagaagaattccgcatcggtcaagcgtgggcgaaccactttttcgttaccttcaataattttgctcggatcgtcaggattaatattggacacgaagataaagtgcggtaataattttccgtctttatcataaatcggaaagtatttttggtcgcctttcatcgtataaaccaaggcttccgcagggacggcaaggaaacgttcttcaaatttagcggtcagtacattcggatattcaactaatgacgttacttcttccaacaagtcttcttcaatatccgccacaccgccaagtgcggtcgctttttctcgagatgttgcaaggatcaacgctttacgttcattgaaatcggctaccacagaaccacgttctttgagcaattgcggatattgatcggcgtgatcaagactaaattcacgctcacctaaaaaacgatgtccacgaacggtacgcccgctcgccacgcctaaaatttcgccttcaatcagatctgcaccgaataaaagcgttacggtatgcaccggacgtacaaactgctcggttttatcgccccaacgcattgtttttggaattggtaatcctgaaagggctttatcaataatgcctacaagcaagtttttagtcggctgaccttcaatcactgcacgatgcaccagccattcgcctttatcggtggaaagacgttcggcttgctcaacggtaatgccacagcctctcgcccagccttccgccgctttggtcggcttaccttcggcatcaaacgccgccgatactgccggcccacgtttttcaacgtgtttgctcggttgagcctctgccagccccaacacttttactgccaaacggcgaggggctgcaaaccattccactttctcaaaagccaaccctgcttgatttaactcttgctcaacattctccgcaaatgcggtcgctaattttttgagtgcctttggtggcaactcttctgtgccgatctcggcgaggaagttttgtgttgtcattgttatttctcaactatacgttttatttaaatccattggctaaacaaattgctttgttcgttttttggggtacttttactcaattcttcacatcgtttttacgtctaccaaataccctaactcaataaaaatcaaaaggttccgttttacttgatatcgttttgaactcattttcttattctacactattttagatagaggcaaaacaagattgcttttgaaaacgctcaatttgccttttcgttgtactgcgttttaacgttttaaaaatcaatctaaactcatatcaaagtaacccagacaagaaaaagaaaaagaaaggataaagagaagagaagaattttattttttttgcgataaatttagacaattttgtagcaaatttataacgagatcagtataatcgcacacttaactaaactggatttaatcatttgagaaaatagctcaaatcaaccctattaacattaatcgaataagaagcagaatatgagcctacagcctacagcctacagcctacagcctacagcctacagcctacagcctacagcctacagcctacagcctacagcctaggctaacgcctttttataaaccttgcaaaataaattttaaaaagtttttaacttctcgtcatacccaaatttccccttttaaccccctttgcgaagatatcattcgcctttttctgctttgccttaaaaagcaaggtattgcctatttagggttatcccctctctctaaagtttaataaataatcagtaagagataataaataaacaatcaataacagattcgatcaataaccatttaacaagtcattcaaagataatttttaaagcgagtaattctatgaacaaaatatttaaaactaaatacgatattacaacaggtcaatgtaaagctgtttccgagttggcaagcaaccgccaaatagcgagcagttcgaagagtaaaccaaagtgcggtgtgtttttgggtggtatgttaggggcgtttaaggtcctgccgttggcgttggtgatggcggggatttttggkgtgwgcagtgtttcatatgctgagataacatatattgatatggayggaacgacaggagcagcaggtgtacaagaaaaatggggtgaagcaccgcattggaaagataaaaaaaatattttgatagcacctgtgcaagataaaggtcaaattttaaataaatttggtggaataaatacaaatgtacagcattctgtaatcataggtcctcatgctgctggtagacaacataaacaaggtatgactatattgggctataatgcagttgggtacgaaagccaagcgacagctttaggaaacaatacatatgctggaggacaagccacagcaattggttctgatgtaatggctgcgggtcttggttctatagcaatagggaatgatgatatatatactgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatatattagatcaaaatgagtttaagaaaaaatatgttagaaatggtcatataaatactaaagtatattccccaacatatgcagccggagtggcagcaatcgctatcggttcaagatcggttgcttatggtgatacttcactctcaatcggtacattatcatttgcattaggcgatagatcgactgcggtcggctttcgtgcgtttgtggattttgccgcagaaggcggggttgcgatcggagacgaatcacgggtatttgccgcgaattcctttgcggtagggaataatgccgaatcaacgaataagggggcgttatcatttggtagtttctcaaaagcagtaggtgagggttctatcgctataggacaaaatgtagggtctaatgccaagttaagtggtgatgctgacaccgaacttgaaaagttgattatgactactacacaaactgctcaacctagtgtatcccctggggatcatggaagtgcaactattacatataacaataccccaagtgatcaacaattaaaattcggagataagaatgaggttgttaagcttggatttgctgcaagcaaccaaaacggcaatccagtttctatgctaattgaaaagctaatacagaacaaagaaaaacaaaaagctcagctacaatatgcttttgacaaaagcaacggcgaggtcattgaaaccactgaaaaaatttataaaactcaaaaagaaggcgatcatgcgatttcgctaggttatcatatttccaacaacggcgataatactattgcgatcgggagtgcttccatcgtcagaggatcgaactcggtcgttttgggggcattaaataacatcggtaaatatgcacgaaataccatcgcacttgggattggtaccaatgtgtataaagaaaactccgttgctatcggtactggggttaatgttgccggtgcgggggttgtggctatcggttccggtgtgggggttacgaaagataataccatcgccgtcggctatggtgctcatagtttatcgggcgaaagtattgttttaggaaatgatgcaagcctaaaagaccatgcttccaaatctatcgtcatcggacaccatgcacaagttgagcataaacttgatgaaccaactaaacaggagaaaatagaaaaagtaaaacgagagaagaatatattttcaaataacggcaatgtagaattagagatgtccgccattgcgataggggcaggctcaaaagtttatgctgaaaaaggcgtagcattcgggaataatgctcaagttragsarcamgcgagcagtgcgatggcattaggtaatgatgccgaagcgacgatgcaaaactccgtggcgttggggtataaatccaccaccaaatatttttatgagggcaaaacgggcaatactgcaactattacttcatcaggcggaccaaccgttaaaaatgacagctctaccaagaccgctacgttaaacgggagaaaagctattgagttagatccctatattccggaggggtcaagctataatttagcaaccaatgaagcggcgggtattgtgtcagttggttggatgaaaaatggaagtaatggtagcggtcaagaacttggattgagaagaattgtcggcgtcgcaccgggtgcgttggattctgacgtggcgacgattggacagttaaaagccttagcttatgtgaaaaaagagggcgtggttacctactataccgaacagaacgggaagatatataaagtcgttaaaaatcctgagggtaaattctttaaagtcaatacggacaacggaacaccgctcgatgataaagaaattgataaaaacaaagtttttgccggtccaaaaggggcgaatgaacaacctgtcatgatagacggcaaaaaaacagcaaatatgggcgaactaattaaatttggtcatatagctgatggagaaattgctgaccagtctaatcaagcgattacggggagtcagctgaatcagcttggtaaaactattttaggtttgactgtaaatagtgataaaacaaaatttgatacgcctaaatttacagcggttaattatgaaggagcacaatccggaacaaataaccaaataacaacatttaaaaaagccattgatgaactgattacagcagtaaataaagggcttaacattgcaggagatgatgcaaacggacaacttaccctaggctcaactttaacgattaaagcggggaatacaacggttratgatratagagtaggaacaaaaactgaatattcaagtrataatattaraacagcatatcaatcgaakaacaaaasacttttaataggcataaaagaaaatcctacctttaaaaargttacattgtcagaagaacaaacctatccttctgrtwcacaaamaaatrcggtcgrtaaaaacgayttaattactaaaggctatttagasggtgcattagcaaacgtcgctacgagtttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaagcggtttagggttaaatggtactggaaacggaaatgcygrcattattraaaaagtcctcgcgggaactcttgatagcacaaacagcggtggcagtagcacgacaattgccamyaacgccrtcaatgtcaaagacctgtccgaagtcgctaaagcccttgtggaaaaaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccttggggtcgaatattaccatttcaaaagataatagtaagagtaacgattctgtcatcgctataggaaatggagtagagttaaaaaatgcactacaatccatcggtgtgggtaaacatactaaagtaaccaattcagaatggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtgcgaatgttaagcaaaacgccgcaggtgcggtcgccgttggtgagggtgcgacagttgaagaaaatgcaggcgattccattgcgttgggtaaaaattcaaaagctagcgacaagaaaaatgcaccgagtggtgcagaggtttttgctggtaaaaatagcttaaaaatcacttgggcaagtgcaggaacgtcttctggtatgacaaaagacaaaaccgtagtcagtgtaggggataagggtagcgagcggattatcaccaacgttgccgcaggtaaagtcgaaacaggctcaaccgatgccatcaacggcggacagcttgcggaagtgattagcgtttttggtaaattaggttttgatgtacttggagcagagaaacatgatagtgaagatggtttcaaaaaatccacttttnnnnnnnnnnnnnnnnnnnnnnnnnnnnnnnnnnnnnnnnnnnnnnnnnnnnnnnnnnnnnnnnnnnnnnnnnnnnnntttagagaagctattaatgaaagcattacggctattaacaagggcttgatgttcagtgcggatcaaagtgcggtaacaaacggcactcaaaacacaccgcactatctcggctcaaccattaatattgtgcgtttaggtatgaatcaggctggttcgtctgctacaccagctccggcggggacttcatcacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntacgctttctcaaaaacaaatgtatgagaatggcacaggtagcggaagtggtgcaagcggaagtacagttggtgaaaatgacctcattaccaaaggataccttgaacaagcgttaaataaatttaagttcaaggttgaaaatggtagtggtaagcctatcgaaatcggtcgtggcgacactttgaagtttacgaacggacagaatatccaagtaactgtaaaagatggaaatgatagtacaacacaaccaagtnnnnnnnnnnnnnnnnnnnnnnnnnnnnnnnnnnnnnnnnnnnnnnnnnnnnnnnnnnnnnnagcagctgcaccgccgtctgcttcggcaagtagcacaactacaacaccaaccacgagtacaacaacgactggtacaccaaccgcacctactacggctgttgttaccatagcgacaaaagacgagttagaaaatataaaatctatctcctcacctaaaggaagtgcgggcggaaatggtgctggctcaactggagaagtcaccaaacttaccttagatgctgaaaatgcgactttccaagttggaacaacaggttctaaagtgaaaattgataaagagggtatttcactcacgccacaaggggcgaataacacaggcggagcaaatggagcaaatccatttgccgatacagcatcaatcactattaaagcaggtgcaaaaccagcggatccaaaaagtttagattcacttgatcctaataacggaccttcaatagagttctcagccaagaaaacaagtgatggtaaatctattggcacaggaaaaatcaccggtctgaaagatttagaagcaaattctgacggcacgagtgcggtgaataaaaactatgtggataaactggataaagtgacggtgaaatatgatgatgaacataaaaaatcaatcactttaggcggtaaacctcaaaatggaggtaaggctcatgaccctgttgccatcaaaaatctaaaatccggtttagggcttgatgatatgaaagataaaccggattctcaaaaaaatggattaagttttgaactagtgaaaaaattagttgctgagggtatgagcggtcagcaagggcaaaaaatgacaaaacaagacctgcacaaagcggctaatctcgctgatttaaaagcggttgcacaagctgggttgagatttaaaggaaatcagggcgatgatgtggtcagaaaaatcagcgataccttaactattaaaggggaagaaaacgctacaactggttctagtgccactgacaagtttaacagtacgacaaccgccgctggtaacattaaggtagaagccaatacagccaaagatggtttagaaataaaactgtcggatacgttgaaaaatatgaaagcctttgaaaccaaagaggagrgcggtaaraaatcgacgttaaatagcgagggcttaactgttgwnaacaaaggtaaagatggcaatagtaaaggtacctckgcmacytatggtgcggacaatatcatgttggaagataaaggtaaaaacaataaagcmacaataacygctgaaagccttayctttgctgacaacgtagcacaaaatcagcaaaatccaatgccaaaagctgttcttaataaaaacggcttaaccgtaaccggcaaaaacggtgaaattaagattgatggtgaaaacggtattattaccgtaccggatattaaaccaacaaccagtggaagtgcggtggtgaataagaaatatgtggatggtcaactcagtgccgctgtcaaccgcttggataatgtgatcagtgccaacaacaaacgcttgcaatcaggaattgccggtgcaaatgcggcggctgcattgccaacgattgcgatgccgggtaaatcagcacttgcagtctctgcgggtacctatagagggcaaagtgcggtggctttgggctactctcgtgtgagtgacaacggtaaaattatgttgaaactacacggcaacagcacctcaaccggcgatttcggtggtggtgtcggtatcggctgggcgtggtaagctgaggtcaaactatcaaaaaaagcagtgataatctgttccttggtcagttgtttttttaatccaacttctaggtgaagatcagaatcactgcttttttgtttgttggtgcggtatttgcctgagagcaatgcatgataaaaaatagtcagttaaatactgaataacgatgccataatgtataggtgaaatttcgagataaaagcaaaaatctattacatcatttcattactaataaatttagcgtaaaataatgccatctataattacatagcagaaataaaaatgagcctacaagcctacaagcctacaagcctacaagcctacaagcctacaagcctacaagcctacaagcctacaagcctacaagcctacaagcctacaagcctacaagcctacaagcctagtatattggctaaaaacaaccttgcaaattcattatgaaaggttgttaatgtctaaacaaaaatccaagaccaatcaatctcaatctattactcaacatagttttcgtttttttgatgcctataaatcattcatagatttaaaagattgttgtttatttctcagaacgaacgatatcaatactattggtatgtttgcagttaatgtacttgcatttcctcacaaaaaaacaccgcactaaaataagatgttccgagaagataatatgaatttaattatatgctgtactccattacaggtaatcatcgccgaaaaaattatcgaacgttatcctgagcaaaaattttatggggttatgttagaatcattttataacgataaatttgatttttatgaaaataaattaaagcatttatgtcataagtttttttgtataaaaattgcaagatttaaacttgaaagatataaaaatttactttctttattaaaacttaaaaacaaaacttttgatcgtgtttttttggcaaatatcgaaaaaagatatatccatattattttaagtaatatctttttcaaagagttgtatacttttgatgatggtactgcaaacatcgccccaaatagtcatctctatcaagaatatgatcattctttaaaaaaaagaattactgatattctattacccaatcactacaattccaacaaagtaaagaatatatctaagctacattattcaatttatcgttgtaaaaataatattatagataatatagaatatatgcctttgtttaatctagaaaagaaatatacggcacaagataaaagcatctcaatactgttaggtcaacctatatttaatgatgaagataaaaatattcaattaatcaaagaagttattgaaaaatttaaaattgatttttattttcctcaccctcgagaggattatcatatcgataatatttcatatattaaaacaccgcttatttttgaagaattttatgcagaacaatctgttgaaaataatattaaaatatatactttttttagtagtgcggtattaaatatagtaaccaaagaaaatattgaccatatctatgctttaaagcctaaattaactgaaaaagcatatttagattgttatgatatattgaaagattttggtataaaagtgattgatatttaaaatttctagcaaaaaaaaataaataaatgatcttaaattaatccgtaataatgaacttcattattcactttataaagcaagctgaggagtaaatgttacggtaagttcaactagttcatctaaagagattattttcatttgcggtaactgtacaaatattttttcacttaaatttctcgcctcaacatcaggttgtaaaaacataataggtatattaaggcaagcaaaaatttgagggtgctttaagggtaataaaacagcatcttgccataaaactaatacatcttgtggtgtgacttggtctaaataaccggttaattcatttatgtcgtagcttgattgagaaaaggtatagagcatattatttatccctaaaaagttaaaattttctctgcctgatttagtttttgtagcaacaaagtgcggtcaattttttgacaggaaataataaaatcttggcaagttaactggtatttttcacaagattgccggcaaatataacgttgctcaatttcatatagatccaataatttaaaagtacggatgaaatctttttgcaaaataatttcaggtttctgctgattaagtaaattaaaaacaccatcttctaagaagaagaccgcaatttcatcttcattacaaaatgccgttgccgccaacagtgcatctaaaccttctcggctaatactgctaccatgtggtgcttggcgaaagataaaagccagttttatcatattgttatcaacctatctgcttgcaaaactgccttattaaactctcctaatcctgccaaaataaaaccttctgctaaattattttgttgctggttatttgaactcagcggttcaacgatacctcgccgttgtgctgctgaaatacaaagatgcaatggaacagaatatgtttgacttaactgttgccacgctttttgtaaatgaaattcgtcatttgccggattgacaaaagcattacctaaagttaccccttgttgaaaaaaaaagatttgttcaatttgatgacctttcgccaataaggtttgtgcaaattgataagcaagatatgccccttgtgtaccataaacaggctgtttaaccgctaaaacataacgcattattctattccttgctcttgtttgagttgacggatatagagataaacggtatgtcgagagatatttaagcgttccgctactaaattaatcgcatctttaatatcaaaaatacctttttcatataaggacaggacaatttgacgatttttgttatgatttgcaacaagacgatccgctgtaatttcttcgatagtttgttctatagtttgaacaacaagctcctctactgaactggcgaaattaactgctgacatttccacttgttcaggtgcgggcatcaatgcctgaataaattgagacatgggaatatccaaattaatattaatgcaaagtaagcctataatgcgttgattaccgttacgaattgcaatcgtcaccgatttcatcaatcccttacttttagatcgagtaaaataaggtttagacacactctcggtttgcatattgtgcaaagacgttaatgcaaaatttgtaatcggcgaccccacttggcgattggtattatgtccattggcaatacaaatagccgaatgctcaaggtcttccaaagagtgtaaaacaatttcacagtgctcaccaattaatgcactaatcccctcaaccacagcgatataagaattgagaatagtatgatcttcatttgtaaaagggcgtctatccgataacatgcttaatttcccttatttttctcaccgcactttaggctatttttaatgtaagtgcggtgagttttactttatttttcagaagttacatctaagatttcaatatcaaaatatagcgttgaactcggtggaattaggcctgcacctctttcgccataagctaagtcggcaggaataaccaactcaatttttccgccttttttaatgaattgtaaaccctctgtccaacctaaaatcacttgatttaatttaaattcagcaggttgtccacgctctctggaactatcgaatactttgccattggctaatttgcccgtgtaatgtactttaacacgatctgtcggtttaatgctcttaccttctcccattttttcaatacgataaagtaaaccgctttccgtttttttcacattcgattttttagcaaattctgctgtaaatttctcattttcagctttgattttagccatttttgcatgacgtgctttgttttctaactcttgcaacgtttcttgtgctttttcatcagttaaagtgcttttattttctacaacatctttaatgccagcgacaattttctcataattgtaactggcaacatctttgtgttcttcacccatcaccgttaaatattttcccataaaatagcccaaagcataagaaacatcatcattgaactgcttatcagcaaaaacagattgagaaatgaccgcacttgctattaacgctattgcagaacgttttttaatttttaacatttttcttgatcctttataataaaaatatgaaatgttgaatagattaaattgtcttgttcaaatgcacaatcattattttttaattagagactatttatgctacaaactcaagaattagatcaacgtattgcagaattagaaatgaaaattgcctttcaagaaaacaccttagaagaattaaatcaggcattaattgatcaacaatttgttttagacaaaatgcagttacaattacgctatatggcaagcaaattaaaggatttacaatcttctaatattgcaactcaagcggaagaaacacctccgccacattattaacttattgataaacatcaagaatatcaagaggataggtttttccggataaataatcttccacggcttgtaataccaaaggattgcgagccgcttgtccatcttgctgaatataatggtgaaactcctccaagctcaaccaaagccctccggaaatatccggatcagaaggtgttatctcaacccaatctgttaactcaacagaaaaaacaaaacgtaaataatcagttttagaacgaggtgcatgccattggtaaatctttaataagttttgcatctctgctcgaataccggtttcttcaaataattctctttgtgcaccctgtaaaatagtttcatttttttctagatgcccggctggttgattaagcgtcattttgccgtattcaaattcttcgacaaataaaaatttgcctttgcagtgcacaacacaagccattgtaatatttggtttatacatattagatactctttttaacttgttgatataaattttgtaattcggttaacgtaagctcacgaaattgtccattggctaaattggtgagcgttagccccgctgtttcataacgaattaaacgcaatgtgggaaaaccgatatgggcagtcatacgtcgtacttgacggttacgcccttcgctaattttaatttccagccagctggtaggaacagttttacgctcacgaatcggtggatgtcgttgccaaatattcggttcagaaatcaaccgcacttttgccggtttggtcaatccatcattcaattcgatgccttttctcagctgtgcaagatcggtttccactggaatgccttctatttgtacccagtaggttttttccattttaaattttggattcgtcagtcggtgctgtagctcgccattattggttaacaataaaagaccctcgctatctcgatctaaacgtcctacgggataaatgtgcggtatttttataaaatcttttaatgttgcccgcccttgttcatctgtgaactgacagagaacatcaaaaggcttgttgaataaaatcactttagtttgtgcaaagttaagtccccttttttgcctacgtttcagtaccgcactttttacaagcgattttatcaagttagtgttgtttaattttttgcgttgaagatccatgttttagataaaaataaataagggcaagccattagctgcccttatgctgattagatttttgccaaaatattattcaatgttgctgaaggacgcatggcttgtgctgtagccttggaatcagggtgataataaccttgaatattttgcggcgtcccttgtgcagcaagtagctcttgattaatttgctgctcattttcttgcaaggcttgtgcaattgactcaaacttcctgttaagttgttcatctttgttttgcactgctaaggcttgagcccaatacattgccaaataaaaatgcgatcctctgttatcaatcgtccccaatttacgtcccggagatttattcttatctaagaaaattgcatttgcctgatctaatgtttctgccaaaatttgtgcttgagcgttattttgcgtttgagcgaggtgttccaacgaagcttgtagtgctaaaaactctcctagcgaatcccaacgtaaataaccttctgcaataaactgctcaatatgttttggtgcagaaccgccggcaccagtttcaaataaccccccaccattcatcaatggtacaattgaaagcattttggcagaagtacctaattctaagattgggaataaatctgtaagataatctcgcaacacattaccggtagcggaaatagtatccaagccttgacgaatacgatttaatgaaaatttgcaagcctcaatcggagataatattttgatgtctaaatttgttgtatcaaattcagctaaataagaccgcacttttttgataatttcacgatcatgggcacgattttcatctaaccaaaaaacaaccggcgtattggtaactcttgctcgattaactgcaagtttaatccaatccttaattggtgcatctttcgtttgacacatacggaaaatatcgcctttctccacattttgtaccaaataaatttcaccgtcttcgcccaccacttgaattaccccttgctcttcagcttggaaagttttgtcatgtgagccgtattcttccgctttttgtgccattaatcctacattaggtacggaacccattgtagtcggattaaaggcaccgttatttttgcagtcttcaatgaccgcactataaatccctgcataacaacgatccggaatgagtgctaaggtatcttgtaattttccttgactgttccacattttgcccgagttacggatcatcgccggcatagaagcatcaacaataacatcagatggaacatgcaagttagtaatccctttatctgaattcaccatagcaatatccggtccttgctccattgctttttcaattgccgctttgatttcattttccttggcatggccggcgattttgctataaagctcacccaacccattgttcgggttgatgctaagttgagtaaacacatcagcatattgtgcaaaaacatcggcaaaataaacagaaacaataacaccgaaaataataggatctgatactttcatcattgttgctttaagatgtgttgaaaataacgtaccctccgctttagattgagcttttgcttgtgctacaaaatcttttaacgcttgtaaactcatcactgaggcatctattacttcaccagcttttaacggtgcaaattttttcagcactttcttttcaccgtttgcagccacaaattctatttgaaattgtcccgcactttttaccgttacggatttttccgtaccataaaaatccccttgttgcatactgacaacctgggtttttgattgtgcagaccaatcgcccattgagtgcggatttttctgtgcataatttttcactgcttttggtgcacgtcgatcagaatttccctcacgtaaaacgggatttaccgctgaacctaatacttttgtgtaagccgcttttatttttttttcttcttccgtctgtggttctgttggatagtcaggaacagcaaatccttgttgttgaagttctttaatggcggcgttaagttgaggaatagaagctgagatattcggtaatttaataatattagcttccggtttagtcgccaattcacccaattcagcaagggcatcaggaattttctgttcctcactaaggtaagcagataaattggctaaaattcgccctgcaagagaaatatctttggtttctacatcaatatttgcgacagcagtaaatgcttgcacaattggaagaaaagaataagtcgccaacattggtgcttcatcagttaatgtataagtaatttttgctgacataggcatgttcctgtatagatatgaattggttaattggaatgaatttgctctttatggtattagagcgttctaagcataacaaaaaaataacaataatgttattttatgcgtacaattttttcaaaatttaaacaatatctggaaagaatatatacagataaatgatatttatgtcataatccgagcgatttcgttttttattttaggagctattatgtcaaaaccattaaattttgtgatgatttctccacattttcctgcaaactttgaaacttttgccgttcgtttaaaggagtgtggttttaatacattaggtattgcagacacaccttatgaacagttaagtgaaaacttgcgtaattccttaacggaatattatcgtgttgataatatggaagactacgagcaagtctatcgtgctgttggttattttgcacataagtatggtcgaattgatcgtattgaatctcataatgaatactggcttgagcttgatgcaaaattacgtacagattttaatgttcccgggtataagaacgatgatatgttggcaatcaaaaccaaagcacaaatgaaagaaatttttcgtcaagcaggtctgaaagttgctcagggaaaagtatttaactctgatgatgaagcacgtaagttagctaaaaaattgaagtttcctgtgattattaagccaaattcaggagtgggtgcaagcgatacttataaaattaagtcggtacaagaattagaggactttttttcttataaaaatgcacacgttgaatacatcatggaagaatttattgatggggacattattacctttgatggtttaaccgataaagagggcaatattgtgttctattccggtcttgaatattccgagtgcgtattggataccgtagaaaatgataacgatatgttctattacgttcctcgagaaatttcaaccgacttaattaaattaggacaaaaatgtgttgatgctttcaacgttcgtgagcgtttcttccattttgagtttttccgtgtgaaaaaaacaggtgatttgatgccgttagaaatcaattgtcgcccacccggtggcttgactattgatatgtggaattatgcaaatgattttgatgtattcagagaatacgccaatattgtgaaagaaaataaattctacacaaatattacacacccatggaatgtggtatatatctcacgtaaagcaaataagaattatgtaaacgccattgaagatgtgcaacaaaaatattctactaatattattagtgtgcaaactgtacccggcgtttttgccaaaattatgggggaacatggcattttagctcgcacagaaactttagatcagatgcatgaaattgcacaatttgcacaacaaaaagcataactttgttttaatttatagacaggatttccctgtctactgtaacttttaggaaaaaaataaatgcactttgaaagacgtagccattggagcggtgaattgggacgtgaaatgcactttaatgtgtatggtcatgcgggtaagcctgtgattgtatttccttcatccggtggaaatcaaaatgaatatggtaactttggtatgattgaagcttgtcgttcttttattgagcgtggcttaattaaattttatacacccgactctttcgataatgaatcttggctggcagaatggaaatccggacatgatatggcacaggcacacaatgcttatgatcgctatattttaaatgaacttgttccactaatccgtcatgaatcaaaatgggacggagcaatgattgcgacaggttgtagtatgggggcattccatacaattaactttgctttgcgtcatccggatttatttgatgttgcaattgcattgagcggtgtttacgacgcacgtttctttactcatgaatatcatggtgattctaccgtttattttaactcgccaattgattatttatggaatcaacatgataactggttcttagaacgttatcgccaaaatcattatattgtggctgttgggcaaggtgcttgggaagaacaacatatagcggatacaaaacgtttagaagaagcatttcgcagtaaaggaatagaaggttggtttgattactggggtcatgatgtggatcatgactggccttggtggcgagttcagatgccatttttcctctcaaaattagaggaacaggggattatttaatcaataaaggaaaacataaaaatctatggagatctcaaaaaaccttactaaggtattcatgttccttgtattggtcataatttatatgaaattgcttatcaggcaatcagtttagcagttcgagaaataagtgatagaaacaagatcatttctaaaattgtcattagaagtcggctaatagatagtaataaataaaaaactaaggggaattcagacttaaagaacaaaattagtgatcaaaacctagttaaatccttataataaatacaagaagttaactgggtcagagacttttaatgcagattgcagtagtaatgatcttcaaaaatacgaccaaaattaaggctaaacaacgttataaatgaaaaagtgagcataaatctgctcactttttgatgctccaactacaattccttataaattttagaattgtttttgttcatttaatggtgttttacttaataatcttagcaacaacacccgcacctacagtacgtccaccttcacgaatcgcaaaacgtaacccttggtccatcgcaatcgggtgaattaagcttactgtcattttgatgttatcgccaggcatgaccatttcaacaccttccggtaattcaattgtacctgttacgtcagtagtacggaaatagaattgtggacggtaacctttgaagaatggcgtatgacgtccaccttcttcttttgacaacacatacacttccgattcaaagtctgtatgcggtgtaattgaacccggtttcgctaatacttgaccacgttcaatttcttcacgttttgttccacgtaataatgctccaatgttttctcccgcacgaccttcgtctaataatttacggaacatttctacacccgttaccgtggtttttgttgtctctttaataccgacaatttcaacttcttcaccagtacggataataccacgctctacacgtccggttactactgtaccacgtcctgaaattgagaaaacatcttcaatcggtaataagaacggttggtcaatcgcacgctcaggctccggaatatagttgtctaagtgagacgctaattcaagaattttttcttcccactcagcaactccatttaatgcttgtaatgctgaaccacgtacaattggtgtgtcatcgcccgggaagtcgtattgagaaagtaattcacgtacttccatctcaactaattccaataattcttcgtcatctaccatgtcgcatttgtttaagaatacgatgatgtacggtacacctacctgacgacctaataagatgtgctcacgagtttgtggcattggaccgtctgttgccgctaccactaaaatagctccgtccatttgtgccgcacctgtaatcatattttttacatagtcagcgtgtcccggacagtcaacgtgtgcgtagtgacgtgtcgctgtatcatattcaacgtgtgaagtgttgatagtgataccacgtgctttctcttccggtgcgttatcaatttggtcaaatgcacgtgccgcaccaccaaagtgtttggataatacagtcgtgatcgctgctgttaaagttgttttaccgtggtcaacgtggccgattgtacccacgtttacgtgcggttttgtacgttcaaatttttctttagacacttttcagtttccttttattgagtccccaaaagtgcggtgcaaatttggggagttttgttgattaaataaaattattttttacgtgcttcaattactgcatctgccacgtttttcggtgcttcagcatattttaacggttccattgaatatgatgcacgaccttgagtttgtgaacgtagatccgttgcataaccaaacatctctgctaatggaacttcagcattgattttcacaacaaattcgtttgcttcttgaccgcttaccatagcacgacgacgacttaagtcaccaattacatcaccaacataatcaggtggagtttcaacttccactttcatgattggctcaagtaacactggatttgctttattaaatgccgctttaaatgctagagaagcagcaagcttaaacgccagttcagatgagtcaacatcatggtatgaaccgaaatgtaaacgaacacctaaatcaactacaggatatccagctaatggaccggatttaagttgttcttggatacctttgtcaacagctggaatatattcaccaggaattaccccacctttaatttcgttaacaaattcatatccaggaccttcaggttctagagggtataaatcaataactacatgaccatattgaccacgaccaccagattgttttgcgtgttttccttcaacatcgtttacacgagtgcggatagtttcacgataagatacttgtggtttaccgatatttgcttcgaccttgaattcacgacgcatacggtcaacgataatatccaagtgtaactcacccatacctgaaataatagtttcacctgactcttcatcagtgtgtacacggaaagacggatcttcttgagcaagacgccctaatgcaagacccattttttcctggtcagcttttgtttttggttcaacagcaacagaaataaccggttccgggaattccatacgctcgaggataattggtgcatccattgcacataaagtatcaccggtacctacatctttcagaccgattgcggctgcgatgtctcctgcacgtacttctttaatttcttcacgtttattcgcatgcatttgcacgatacgaccgaaacgctcacgtttgtcttttacagaattcaatacagttgcacccgattcaacaacaccggaatatacacggaagaatgttaaattaccaacgaatgggtcagtagcgattttaaatgccaaagctgcaaacggttcatcatcactggcatgacgctcaccttctgtttcatctggattaatacctttaatggcttcaatatctgttggtgccggtaaataatcaattacagcatcaagcatcgcttgaacacctttatttttgaatgctgatccacaagttacaaggataatttcagtttttaatgcacgtaaacgtaaaccttttttaatttcttcttcagttaactcatcacctgaaaagaatttatccatcaactcatcagaagattcggcagcggcttcaactaagtttgcacgccatttttcacattcagcaagcatctctgcaggaatatcttcataggtaaaagtcatcccttggtctgcttcattccagttgatcgctttcattttaattagatcaacaacacctttgaaattatcttctgcaccaataggcaattgtagaggaacagcattgccacctaaacgtgttttgatttgctcaacaacacgtaagaaattagcaccggtacggtccattttatttacgaaagcgatacgcggtactttatatttattagcttgacgccatactgtttctgattgaggttgaacaccaccaaccgcacagtaaaccattaccgctccatcaagaacacgcattgaacgttctacctcgatagtaaagtctacgtgtcccggagtatcaattacattaatacgatgttgtggaaattgttgcgacatacccgaccaaaatgccgttgtagccgcagaagtaatagtaataccacgctcttgttcttgttccatccagtccatggttgcagcaccatcatgtacttcaccaattttgtgacttacacctgtatagaacaaaatacgctcagtggtagttgttttacccgcatcaatatgcgcactgataccgatattacggtaaagtgaaataggggttgtacgagccattattatttccttgtttggaataaatttaaaatatgaacaaggctccaccgcatagtaatgtgatgaagcctaaaaaacactttgctactctaccaacggtaatgtgcaaatgctttattagcctcagccatacggtggacatcttcacgttttttcactgccgcacctttgttctcagaagcatctgataactcattagctaaacgcaaagccatagatttatcaccgcgcttacgtgcagcttcaacgatccaacgcatacctaatgcgttacggcgagttggacgaacttcaaccggcacttggtatgtagaaccaccaacacggcgagatttaacctcaactgttggacgtacgttttccaatgcaatttcaaaagcctctaatgcttctttacctgtacgttgagataacgtttctaatgcaccataaacgatagattcagcgatggattttttaccatctaccattaaaacattaataaatttcgcaagtaattctgagccgaacttcggatcaggaagaatcttgcgaggttcaatacgacgacgacgtggcattgtaatttctccgttttttatcttcaggattatccaaaactctttatgtaagaaatgacatcttacttttactggagtttatggtaattaatttgttaattagcgtttggccttacttaacggagaaccattaagctttaggacgtttaacgccgtatttagaacgactttgtttacgatctttaacgccagcacaatccaatgcaccgcgtactgtgtggtaacgcacccccggtaagtctttcacacgaccaccacggattaacactacgctgtgttcttgaaggttatgaccttcaccaccgatataagaagttacttcaaaaccgttagttaaacgaatacgacatactttacgtaatgctgagttcggttttttaggtgtagttgtgtacacacgagtacacacgccacgtttctgcggacatgactctaacgcaggaacgttgctttttacaacctttttcacacgcggtttgcgtactagttggttgatagttgccattaataaaactccaatagtttttacaaaaatgtatatttaataatctatctatacaaagatagacgccgaattctaatcacacaaagtgatattgtcaagaattaagcaattctatcctgcaaaaataacgaaagattccatttagattgggtgaagatctatgctttaagtttctcaatagtttttttatcaaagaaataatgtgtaccacaacattcgcattgcatatcaatactaccgccatgttctgttaaaatattttcaatttcatcatcggaaatcaaaagtaatgcagatccagaacgctctaaagaacaaccacaatgaaattccaccgcacttggtggataaatctccacagtttcttcatggtataagcggtacaatagttcttctgcagttagtccaaataattcttcattttttactgttgcagctaatgtcgcaagatgttcaaaatcctcttgtgaaccggtaccatcaggcatgatttgtaataataatccagcagcaacaggttttccctcatattcaccggaacgaatcaataattgtgtttgtagctgttccgaacgaatgaaataatcctctaagcactctgcaatggttggtttatctaatgcaatcactccttgataacgctccccatttgttggggctatagtaattactaatataccattgccgactaactctgataaggtcatatcatcatacacatcatcttgtaaacgagccaatgcacggatttgttgactatcactgccgttaactaacaataattttaacggaccgttaccttgaatttgtatggtaatattgcctttgaattttaaagttgctgtcaataaattggtagcgaccatcatttcacctaataaattccgtacaatacgaggatattcatgtgagttaagtgtatcggtgaaagtcttattcaaacgtacccactcacctcgtacggcacgatctttaaataggtaacggtaaagtttgtcattatctgtttgatatatcatatatttttcctgtttattcaaattttcaatatctatcgtctttataaattgaatgctattcctgatacttaaacttcaataaatctctccgctcttttttatttggacggcgatctgggtgtggcatagaaagtgcattattcttacgtgcgattgccattttctctcgctgttcaacactcctagcggtttcacgatacaacaattgtgcttccggtgcaccacgacgttgtgcagatagggctagcacttctacttctttttcttcactaccttgacgcaatttgagtattgcaccaatttccaccgttttatttggtttagtacgttggttattataatgcacctttccaccgtcaatcatttcttttgcaatagtacgtgtcttataaaagcgagctgcccataaccatttatcgagccgaatgctatcatctttttctttgggtaaatgctgttttgccatatttgtcttttcattcagttaacatcaggggtatgatagggcgattaaagacatttgtaaaagggaagattatgaatgaattgaaaagtcgggtattactggaaaaggttttacaaattgcttatcaagcaggagactatctcaatcgtttttatgacggaacgattgagtttcagatcaaaacaaaatcggataatacgcccgtcacaaacgcagatttatttgtcaaccaatttctcatcgaaaaattaaccgcacttacaccacatatccctgttttatcggaagaaaactgtcaaattcctttttcacatcgtcgacaatggagtacttattggttgattgatcccctagatggcactcaacaatttatcaatcgaacagatcaattcgctgttctcattgcattggttcatcaaaataggagcatattaggtattattcatgctcccgtattaaaacaaacttattatgctctgcaaggtcatggtgcttataagcaaactgaacattatctacaaaccttgtcagccagagagattgacttaaaccacagagtaaaaattgcggtaggttcaaaaagtgcagcacaaaaagtgcggtcagttttgaacccgaattatcaatacgaatttattacttatggttctagcggtttaaaaaccgcactggttgcagaaggaagtgcagattgctatattcgactgggacaaaccggtgaatgggacacagctgctgcggaagccattttatccgaaataggcggaggaatccgtgatacccaattcaacgccctaacttataacaaacgaccgagtttaataaatcctgattttattatggtatcggacatatttgccgattggaaaaaaatctttcaatttaattaatgagaactattggaaatttagctgatttcagaatattattcacttcttttaatatcggacttagataaaatatgaacgtaaatgcagaaaataattgtattgttatttttggagcttcgggagatttaactcaccgaaaattaatccccgcactttataatttatacaaaataggacgtttgacagaaaatttctctgtgttaggtgtttcccgaactgacttaagcgatgaagaatttcgtgaaaaaatgcgtaatgcgttgagaaaaacagaagatataacagaagaacatttggaaaaattttgttctcatctttattatcaggcgattgatacctcgaatgcttctgattatggaaaacttgttcctcgtttagatgagctacatgatacatatcagaccggaggcaatactctttattatatgtccacaccgccaagcctttacggtgtgattcctgaatgccttgccacacacggactaaatacggaagaatgcggttggaaacgtcttattgtagaaaaaccttttggttatgacataaaaacagcaaaagaacttgatgtgcaaattcatcgtttttttgaagaacatcaaatttatcgtattgaccattatttgggtaaagaaactgttcaaaaccttctcgtattacgtttttccaacggcttatttgaaccgctatggaaccgcaactttattgactatgtagaaattacaggtgctgaagaaatcggtgttgaagaacgtggcggatactataatgattctggtgcaatgcgtgatatgttccaaaaccacttattacaagttttagccatggtagcaatggagccccctgctattattaatgctgattctatgcgtgacgaagtagcaaaagtgttacattgcttacacccgctcagcgaagacgatataaaaaacaatcttgttttaggtcaatacacatcttcaactatagatggtgaagtggtgaatggttatttacaagaaaaaggcgttccagcagactccaatacagaaacctacattgctttacgttgcgaaattgataactggcgttgggctggtgtgccattctatgtgcgtagcggtaaacggctacccactcgtgttacggaaattgtcatacactttaaaacaaccccccatccagtcttcagtcaaaatgcaccggaaaataaattaattatccgaattcagcctgatgaagggatttcaatgcgtttcggcttgaaaaaaccgggtgctggctttgaagcaaaagaagtgtcaatggatttccgctatgctgatttagcaacaccaagcctactaagtgcctatgatcgtttattattagatgccataaaaggcgatgcgacactttttgcacggacagatgcagtacatgcctgctggaaatttgtacaacccatcttgaattataaaaaagatcaagggcgtgtttacgaatatgaagctggaacgtggggaccgacagaagcagataaattaattgctaaaacggggagagtatggcgtaaacctagcggaatgatgaagaaaaaagtctaaatcaaataaatagtaattaaacgtaataactcttgccataaggagtacaaatgaacaaaaaaatttttgatacggctcaacaagcagtcgaacaaatcgctcaagaatttgtgcaatatagcagacaaaatcgtccggtgcatatttccctttcaggaggttcaacgcctaaattgttatttaaaacccttgctcaagagccgtttaaaagcgaagtgcggtgggaaaatttacatttttggtggggagatgatcgtatggttgaaccgaataatcctgaaagtaactacggtgaagtgaaaaaattactgttcgaccacattagcattccaactgagaatattcatcgtattcgtggcgaagagaatgtagagcaagaactcgcaagattctcacaagaattaaccgcttgcgtgccaaaccttaatttcgactggattattttaggaatgggaaccgatggtcatactgcctcacttttcccacaccaaacggattttgatgatcaaaatgttgcggttatcgccaaacaccctgaaactgggcaaattcgtatttcaaaaactgcaaaactaattgaacaggcaaaacgcattacttatttagtgaccggtgaagccaaagcggaaattttaaaagaaattcagaccgcacttccggaaaatttgccttaccctgcggctaaaattcaggcgaaaaatgggataacggagtggattttggatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgtcacaaaaaggcgatatcggcgtgattggactcgccgtaatgggtcaaaatttaattttgaatatgaacgacaacggctttaaagtcgtggcgtataaccgtactacttcaaaagtggatgagtttttagcaggtgcggcgaaaggcacgaacatcatcggagcctattcattggaagaacttgccggtaaattggaaaagccacgtaaagtaatgttgatggtacgtgcgggggaagtggtggatcaatttattgaggcattactaccgcacttagaacaaggcgacatcattattgatggcggtaactcaaactatcccgatacaaatcgtcgtgtaaaagccttagctgagaaaggtattcgctttattggctcgggagtttcaggcggtgaagaaggtgctcgccacggaccatctattatgccaggtggcaatgaagaagcatggcaatatgtaaaaccaattttacaagccatttcagccaaaaccgacaaaagcgaaccttgctgtgattgggtaggtaaagaaggttcaggacattttgtgaaaatggtgcataacggtatcgaatatggtgatatgcagttaatttgtgaagcctatcagttcttaaaagatggcttaggtttaagctatgatgaaatgcaacagatctttgctgagtggaagaaaactgagcttgatagctatctaattgatattacaacagatattcttggatataaagatgcggacggcgagccgttagtcgaaaaaattcttgatactgcagggcaaaaaggaacaggtaaatggacagggatcaacgccttagatttcggaattccattaactttaattacagaatcggtatttgctcgctgcgtatcctctttcaaagatcaacgtgtggcggtatctaaactcttcaacaagactatcggcaaagtggaaggcgataaaaacgtttggattgaagctgtgcgtaaagcattattggcatcaaaaatcatttcttatgctcaaggctttatgctcattcgtgaagcctctgaaaacttcggttggaatatcaattacggagcgaccgcacttttatggcgtgaaggttgtattatccgtagccgtttcttaggtaatattcgtgatgcttatgaagccaatccggatctgattttcttagggtcagatccatactttaaaggcattttagaaaatgcgttaagtgattggcgtaaagtggtagcaaaatctattgaggtgggtatcccaatgccttgtatggcaagtgcggttactttcttagatggttatacttctgagcgtgtgccagcaaacttgttacaagcacaacgtgattactttggtgctcacacctacgaacgcactgacaaacctcgtggcgagtttttccacactaactggacaggacgaggtggcaatactgcatcaacgacttatgatgtataattcaatctcaacacaaaaaagcggtgaactgatcaccgctttttatgtttttaaattaaagaaatagtcaatttatacaagttattcattaattgcatgatttactttgtagttaaggggtaagttgtttacaatgcacaaagattttttattcatcaggattaaaaaatgaaaactgtcaaaaaaagcaaattaattatcaccgcactgagtgcaatgttattactttcggcttgtgccactatagatgagcaaaccggagaacgtaaagatcccttagaaggatttaaccgtgtgatgtgggattttaactataacgttgctgatccttatgtgctaaaaccgattgcaaagggttggaaagaatatgttccacaaccaatcagaaagggattgactaatgtagcgaacaatcttgatgaacctgccagcatggttaatcgtttgttgcaaggtgagtttaaaaaggcaatggtgcattttcatcgcttttggattaattcaatctttggattaggtggactcatcgactgggcaagttatagtgaacctctgcaaattgaaaataaacaccgtttcggtgatacgctaggtacttatggcatggaaacggggtcttatgtaatgttaccgctttacggaccggcaacacctcgtcaagatctcggcaatcttgttgatgtaacttatccgatgttatccttattaggtccttggggactgctcaaatcgagtatacaacgccttgattctcgagctaatctgcttggcaaagaaacattattggaacaatcaaaagatccttatgttacattccgtgaagcttatttacagaatgtagatcatcatactcatgatggacaaataaagagaacgcaagaagaattttctaaagaagacttaaaagacatcgactaaactcaagaaggaatttattatggaaatgacctcaactcaacgcttaatcttagccaatcaatatagattaatgggtttattggatccgaccaatacacaaaaataccaacgtttagaagctattgtgaaaggcggtttcggcttagaactgaaagaattggataaagagttttccgatctttcggaagcggaatgtctcactgtattaaatactttggagatgtataacgcattacaaatttcttacaataatttgccagataagtccgctttgacaccgcatcgcttacaatttgcgggctattgtgcagtgcgggagaaaaaatatcttaattacttacgctttatcacctcagtcgaagggaaatatcaagagtttatgcgttgtgaacatggttgcgactcccaaactccaatgtgggataagtacctcaaaatgcttgacgcctggcgtgcctgtccccatgaatatcatttaagcatggcagaaattcaaaaaatcttaaatgcttaattgagtcaacgttggtaaaaaaaccgcactttataaagagtgcggttttttatgtagtttctatcagtaaatttgctacaaccggtggaatacttttggggtgaggaataagaatttgcttatgccgactcagttcacctttttccaaaataatctgactttttgccactttgaaagttttacttaaaaatttcaacaagtgagcatttgcctgtccgtcaatgggtggggcagtaatactgattttcagtgcgttatcatatagtccgataaggtgatctttgcttgctttaggttgcaaaaagatcctcaaacgtaaattatctccaattttttccacagcaggcatacatttctaccaatattgacacgatttaagccaacgcccaataatttcctaataaatcatacattacacgattgccataaaataaaataaaggcaagtaacatgggggaaaaatcaatcatccctgttctaggtagtaggcgacgaacaggtttgagcaagggttctcccaattgatgtaataaataacttaaagctccacgattaaaccaacttaaaatcgctcctaaaaataaaatatataaaaacaattcaccaaaagttcttaaggtgtgtaataacgcaataattacgctttgtccaatgggaaaacgtgcacccactatcgcaaaaatcatatgatattttaatacgcctaatacaaagacaacaaagagcggtgcaaaattaatattttttattgtcggcaaaactttttgcaaaggcaaaataattggattagtgaatttcaccaaagattgtgaaaaagaactataaaaatcaacacggcaatactgaaaccacatacgtaacataaaaagaaaacttaatacgtcaaaaatagtattcaataaaaactgaattgaatttaattgataaatcattataaccatcctttacgtttaaaataccaataaggtgcaaatgctgctaatgccatcagacccaatgccagcggatagccgaacttaaagcctaattccggcatattactaaagttcattccataatttgatgctactaacgttggcggtaaaaaaattaccgatacaacggagaagattttaataatacggttttgttcaatattgataaagcccatagcagcttgcatcaaaaagtttactttttgaaataatgactcattatgcggttgtagggactcaatatcacgcaaaatttctcgagcttgttctaactgattggtaggtaaacgtgttttacgcactaaaaaactcaatgcacgttgagtatccattaaacacaatcgtactttagaactggtatcttcttgttcagtgatagttgctaacgcctgatcaaaagcctcaccttgtttaccttctaaaataatacgactcaatttttccaaatcagcgtacacattttcaattacgtcagctaattgttcaattttagtttcaaataagtctaataacacctcataggcattacattcaactaaacgttgattgcgtgaacgcatacggtatagacgaaatgccggcaattcacgatctcttaaagtaaataatcgcccgtcacgaatggtaaaggcaacgctggctaaatcggcataatcattttcatcttcgcaataaaagaaagagtgtaaatgtaagccatcttcatcttcgaaaaaacgtgcagacgcttcaatatcctctaactctaaaaaagtggctaaattttgcccaagtccttcctgtaacaaatcacgctcttctttactcggctcaagtaaatccaaccaaaccgcattattcaactctgtatcagcactttcatcaatacgaaccaaacgggcatcttcgagtgaaaaagcattaatcattttgtcatgctcctctaaagggattatgaacaacgcaatgaacaaaataaaatcaaataagacacgtataaagtgcggtgaaaattatatttgattaaaagatacctgaaaaataggtaatggaacttacctgcgtaatcccgccgataagtgctagaaagacaagacgagatttagaaaaaagataataggtatcgactatgactgtccaaagtgtatgtcctctcgttactaaatcgtgcggaatgttacgcttgaaatagctgttcgtcaaggatttttgcaagaaaaatcccactaaaagcgggatcttataaacaactttcgatttgactactttgtagggtaatcccaccaaatatcgaataattcactgatttcaatttgttgtaaaccgtttttctccaaccagtttttcaccaaagtgcgatgactttcatcacattttcccaatttttccaaacaaactaaaccttcccaatgaagataaccgctaccttcgtaagcaagtccgttttcttgaataacttcacgaataaaacgatcaacgactccatctacttgctcaataggggtgttttctgcaaattgccaattcactaaaaagccaagctcttggaattctgctaagtgcatttttttacgttgtctttgattacgtttaatcgccatacttttctcctattgttactattcttgtcaggctgggcaatcatagcatatttatcgcctgtccttaataaaaaaacaaaatccgagcttatattaattatttgttgtgaagtaatgaaaaaaatctttgtatcgcaggggaaataaatttgtctttataaaaaatataattaatccctctttcaaaagttaagttttttaatggaatttcaactaacagttgactattcaattcatgcgttacagccagtcttgaaataaaggaaacccctagattattgattacacaatgtttaattccttctaagctgttaaattccattatttttagttgtgtaatttgttcatggttaaaatgttgaaaaataaattttcttgtttcagaaagattaggtttcatgatgagttgttgctggctaagtgcggtgaaatcacatgctgttttttttgctaaaggatttttaggtgaagcaattaaaatgagttcgtcagataaaaatctgtgagtttgataggtttgcggatcaaaataaatttgatccgacataatcaaaaaatcaatttggtgattttctaatttatgaatgagttggggggaaggtaaaatatcaatacttagcttaacgttaggtgatatttttttatattcggcaattattttcgggagcaaataaacacccacaaaatggctggcaccaatagtaatttttccgtagttgggatcatcgtattgatggagatgttctattgaagtttccaatgtagaaagtgtttgctttgcataattttggaaaatcttgccttgttcggttaaataaagtcgattattaattcgctcaaataaaactgtatttaatgactcttcaagttttttaatcttaatacttactgacggttgcgtgcaaaagagtttattcgcagtttctgttacatttaaacattcagaaagtactataaaagctttaagttgacttaaattcatatcaattccataaaaataatttatagcttgtatagaataatacaatttttttatgtttaatcaactctctataatcagattattctatagacaatatatggagtaactcaccatgaatgacacagtaattcaaaatcaagaacaccaatctgcccgaaaagaatggctgaaaaaaatcggtatcccgttagctttaatcgtattacttgtattgatgttcatgccaacacctgatggtttaacggtacaagggcaaaaagcgattgcaattttctgtagtgctttaatcctttgggtatgtggttcaattcctatttatttaacatctttgttagtcattattttattgccattaactcagaccgttgcaaaagataaagttgttttcgctactcttggatatgatgtaatttggttaatggtatctgcttttgtgctgacttcagcaatgattaaatcaaatattgctcgacgttttgctttatggatgatcactcattttggacaaacaccacgcaaggctatgtttgttttgatattaattaattttatactagttttcttcgtaccttctacaactgctagggcttcattaatggtgcctatttgtttaattttactggaaatttatcgtgcggtaccgggtgaaagcaattttggtaaattaatgatgttacaaggtgtgcaagctgatgcaattgcaacatccggtgtaatgacaggaactgccggtaatattattgcggttggatttattaataatcaagctggcggagatattggttatcttgattggcttttggcatctttccccatagcttttgttaccatgataatttctttcttaattggttttaaactgttctcaatgaagaaagaaactcatttttttgaagctttatctcgtcttcaagcagaatataaaaaattaggttctttaactttagatgaaaagaaagctatggcaatctttttgcttacggttctactttgggcaacggaaagttatcaaaaagcatggttcggcttcaaaattagtgtttatatgaccgctgtgatagcagcagttctctgcttaatgccaagaattggattactcacttggtccgaagccaaaattaaatgggatttaatgttgtttgctgccggtgcttatgctgcaggtaataccttagaatcgactaaaggtgctcaatggattatggataaagtcgttcatggattaggtttagaaacaatgagccatacggctgtttatgtggtagtaatcttcgtatgtatgtatgtatagccacttgatttttaccagtaaaacggtcaaaacgacaattcttattccatctattattgccttggcacaatctttagggatgaatcctgtaaccttagctttagctgcgtcatttacactgacatatactataacgttgcctccacattccaaagtaaacacaatttattttgccactggttattttagtgtgttggatcaaatgaaatacggtttggttacttgctttatcggtgcctcgatcatttgtttatcaatttttacttggttccaattacttggatataccttataaaaaaacggagaggaatcatgcgattaattttattacgtcacggcgaaacgctatggaatcaagaacatcgcctacagggacaccaaaactcgccgttatctgaaaaaggtattcagcaagcgaaagcaattaagcctttgattgagcaattctcacctaaatatgtgatcagttcagatttggggagagcactacaaacagcggaaattattggttataaaaatccaattaaagacagtgagcttagagagttggcaatgggagaatgggaaggttgtagaaaaacggaaataatagctcaacatccggctttatatcaggattggcgtaatggcgattacacaccgaatggggctgagagttggcaagcattttgtcaacgtatttcacaagcactactaaaatgggcaaataaatacgatgacgatattctagctattgttcatagcggtgtaattcgagcagcttgtgaatctttagtatcgctatctactaagcatcttttgcctgtaactcaaggaacattgacgatttttgatatcagtcctaatctacctataaaactggaggcttacaatttggggagttttattcccgccagcaatgtagcggactaaaagattatttattttaaaatctagtaaaaaataaccgcactttatagactctgtttaggatttaaagtgcggtttatttttgttagggtttattttatcctttgcattttatatttttctaagttgcttgaaaacgaatttatttagaaacagttgctttaattagtttttccgctttagctaaactattttccaccgctgaataaggggtcttagagtggctaactacttgttcggcagtatttaataacactttcacttcgcctttttctgcttcggtcactaacacctttaatggtaattgtaatgcaagactgggatctttaaccatcaatggtgtgcctgcttttggggcaccgtaaataattaccgttgcaggttgcattgttagccccgattctttagccgctttttgatgatcgatttttgcaaaaatggtcattcctttttctgtgagtgtatctgtaagtacagttattgtttggtcaaaactgtatttactttcaaaagattgtggttgaagtacatcgctatgtgccattgcgacttggcttgcgaaaagtattgaaaaaagagctattttcttcataaattacctcgttatgttatgtttttaataaaaaataaatcccaaaccccatgacccaaattatgaccacgttgttcaaatttggttaaaggacgaaaatccggacgtggaatatagtcattcgttgcagaagtattgcgtaaaccgaccgcacttgttaacacttccaacatatattccgcataattttcccagtccgttgccatatgaacaaagccgtttggtaccagtttttgttgaattttttcaacaaagtgcggttgtacaattcggcgtttatgatgttttgttttatgccaaggatcggggaaaaatagttgtaatccggctaaactattgtctgcaatacagtcttgtaagatctcggttgcatcatggcaaataacacgtagattttttacctgcttttcaactgcataagcgatgcaagcacctactcccggcgtatgtacttcaatgccaagataatttttatcgggattttgtagtgccatttctactaaagatttccccataccaaagccaatctccaaaatcacagggttggtgttgccataaatctgtgtgaaatcaaaagcagttgtttgatactcaagtcctaatgttgcccaattattattcatcatgttacgctgaaattcgcttaaacgtcctgtgcgtaatacaaagctgcgaactttgcgtttataacgtccatcttcagtaaattcagctatttcaacggtctttcttttttgatcggcaaacgtaatcttttgttctgtcatttcatttgactacttgttaattttgggggcaaattataaggggtttaatagaaaatataaagtgcggttaaatttatcaattaagataaagccgcactttttatttgattatgttacacttctttttattttgattacctaaattatgcaggctcaatcctctattaacaatccttttgcttatacagtacttaaatggtatcggcaattcgggcgtaaaaacttaccttggcagcaaaataaaactctatatggtgtttggttatccgaggtgatgttgcaacaaactcaagtagcgacagttattccttactttgaacgttttattaaagtttttccaaatattaccgcacttgccaatgcacctttagatgaagtgctacacttatggacaggactgggttattatgcaagagctcgcaatttgcatagggctgcacaaaccataagagatcagtatcaaggtgaatttccaacggattttcagcacgtgtgggctttacccggtattggacgtagtacagctggggcggttttatcttcagtacttaatcagccttatcctattttggacggtaatgtaaagcgagtgctgactcgttattttcaggtgcaaggttggactggtgataaaaaagtagaggagaagctttggcaattgagtgcggaggttacccctacagagcaggtcgcagattttaatcaagctatgatggacttaggtgcgatggtttgtactcgtacaaaacctaagtgcttgttgtgtccattagccataaagtgcggtgctaatttaaacaataattgggtagattttccgtctaaaaagccgaagaaatcgttacctgagagaaaaagttattttctgattttggagaatcaaggtaaggttgctttagaacaacgccctatttcaggactttggggcggattatattgttttccgcagtttgataccctgactgaattattggctcatctttctcagcaaggtattcaacaatatcaacaatggacggcatttcgtcatacattcagccattttcatttagatatttatccaatttatgcacaaatacaaactcaggaagtagaatttgatcgcacagattggaaaaaaattgcagaaaataacgtagaatatggttctcctatatcaagtgcggtcaaatattggtatgatcctaccaatccaagccaaattggtttggctgtgccggttaaaaatttattgatcgaatttcaaaaaaggaaataattatggcaagaaatgtgttttgcacttacttaaatcaagaggctgaaggattggattttcagctatatcccggcgagttaggtaaacggatttttgacaatatcagtaaacaggcatgggcggaatggatgaaaaaacaaaccatgttagttaatgagaaaaaattaaatatgatgaattccgaacatcgccagttattagaacaagaaatgacaaattttctttttgaagggaaagatgttcatattgagggctatgtgcctccgacagaaaaataatttaacatgaaaaaatatattgtatttgcgattattccttttctttttgcttgtagtagttctacgctaaatgatgactatgatgaagcttttgcaaaagatactcaaggacttgatattttaaccggacaattttctcataatatcgatcaaatttggggagtaaatgaactcctcgtggcaagcagaaaagactatgtaaaatacacagataatttttacactcgcagtcatatcagctttgatgaaggttctattatgattgaaacattgggtgataaaagtcgtttatatcattcgattattcatactttattaatgggtgcggatgcaaaaggaatcgatttatttacctctggcgatgtgcctatcagttctcgtccattcctcgtcggattagttgttgatcataaaggtgcacaagttaaaaatattgcgacggcaagtaattttgcaaattatcttttacaaaataagttgcaaacacgttacctcactaatgggaatcctgtacagtatgttattattccaatggttgcaaaccatgttgcagtgcgtgcccaacgctatttacctctaattcgaaaagccgccggacgttatgggatagatgaaagtttaattcttggtattatgcaaacggaatcaagtttcaatccttatgcaattagttatgctaacgcaataggtttaatgcaagttgtacctcatactgcagggcgagatgtattccatttaaaagggttaaacgggcaaccgtcaaaaaaatatctctttaatcccgctaaaaatattgatacaggtgttgcctatttgactttattacgggataaatatttagatggtataacaaatccaacttcaaaacgttttgcaatgatttccgcttacaatagcggtgccggagcagtactacgagtgtttcataatgatcgagatatagcaattaacaaaattaatcgcttatatccggagcaagtatatcgtattcttactactatgcacccctctgagcaagcaagaaattatttactcaaagtagataaagcacaaaaaagttatagggtgattaagaatagcaaatctgatttgccttaataaaccataacaaaagaataattaagttacgcatgcttaaaagctaagatatacttaactgacttttcattaaacttattcatggagaactgttatgactgccctttttaccactgctcaaaactggctcgctcaagaccctgatgcggaaactcgtgcagaattacaaacattactcaaccaagccaaagcaggcgatatgaatgcacagaaagagttacataaccgttttaacggtcggttgcaattcggtaccgctggtttacgcggtcgcttacaagctggttctatgggtatgaaccgtgtactcgtggctcaagcagcgggcggtttggcggaatacctaaaaggctatgatagtgaaccctctatcgtattaggttatgacggtcgtaaaaactctgatgtgttcgtacgagataccgctgaaattatggctggtgcgggcatcaaaaccttccttttgccacgaaaattgccaacacctgtactggcttacgctatcaaatacctcaacactacggcgggcgtgatggtcactgcaagccacaaccctcctgaagataacggctataaagtttatttaggtaaagcgaacggcgggggacaaatcgtctccccagccgatgttgacatcgctaaactgattgacaaagtggctaacggcgatattcgtgacttaccacgtagccaacactacacagtgttagacgatgagatcgtagaggcatatatcgcaaaaactgcctctattgccaaagagccacaagcaaatattaactacgtttacaccgcaatgcacggagtaggctatgaagtgttgagtaaaaccttagcgaaagcaggcttaccacaaccatatttggtcgaagagcaaattcaacctgatggatcattcccaacggtcaatttcccaaatccagaagagaaaggtgcgttagatttagcaattaaactggcaaaagcaaaaaatgccgagttcatcattgccaacgaccctgacgcagaccgtcttgcagttgcggtacctgattcggaaggcaactggaaacctttgcacggtaacgtgattggttgtttcttaggttggtatctagcaaaacaataccacgcacagggcaaacagggcaaattagcttgctcactggtttctagtcctgctctggcggaaattgcgaaaaaatacggtttccaatccgaagaaactttaactggtttcaaatatatcggcaaagtgaacgacttattgttcggctttgaagaagcattgggctacttagtcgatccaaacaaagtacgtgataaagacgggatttcagcagctattgccttcttagatttagtccgtagcctgaaaaaagagggtaaaacactaacagattacgctaatgactttactgcggaattcggtgcatatgtaagcggacaaatctctattcgtgtgaacgaattatcggatatcggcaaaatgatgaccgcacttcgtaaagaaccactaacagaattaggcggtttcgttacacaatttattgatcacagtaaaactgatcgtgctagcgatattctcgtgtttgtgcttgaaaatggtagtcgccttattgttcgtccatccggcaccgagccgaaagtgaagttctacttagatgtgtgcggtacagatccgaaaaatgcagacgaagtattagcggagtttgatgagaacgtacgccaaatcctccgacaagagaagtacggaaaacaggattgctaatttagcataaacacaaaagcacgttttatacctacctgttattttatcgactccatataaaaatcaccgcacttttatctcaataacgaaacaaaagtgcggtagttttacagcaaaatcagttaaaattatccctgtgaagaaatacgtttcatgtctgtcatataaccacgcaattcctgaccgattaattcaatcggatgctgacgaattgcatcatttacatcacgtaacaaaatattatcgatttccgttgctggtgttgactcacctaaatcaccacgttttaacgttggaataatttctttagctaaaattggagccgctacgttagcaaataaataattaccatactcagcagtatcagagatgactacattcatttcatataaacgcttacgagcaattgtattggcaattaatggtaactcgtgtagtgattcataataggcagactcttcataaattcccgtttctaccattgtatcaaaagccaattcaacgccagctttaaccattgctaccattaatacgccatgatcgaaatattcttgttcggaaattttaatattttctcctttcggtgcattttcaaatgctgttttaccggtttgttcacgccatttcaataaattagcatcaccgtttgcccagtcttccatcatgacacgggaaaattcaccgctgataatatcatccatatgttttttaaatagaaaatccaatttttctttaatttgctcggaaagggaaaatgcacgtaacttagcactattagataaccgatccatcattaaggtaataccgccttgttttaaggcttcagtaattgtttcccaaccatattgaattaatttacccgcatatgccggatctttaccatcagcgattaacttgtcataacatactaaagaaccagcctgtaacataccgcataaaattgtttgctctcccattaaatcggattttacttccgcaacaaaagaagattccaaaacaccagcacgatgtccaccagtcgccgcagcccatgctttagcaatggctaacccttcacctttcggatcgttttcaggatgaacagcaattaacgtcggcacaccgaatccacgtttaaattcttcccgcacttccgtcccaggacacttaggagcgaccattaccacagtgatgtcctgacgaattttttctcccacttcaacaatatttaaaccatgcgaatatcccaaagctgctccttgtttaattaacggcataacatcagcaacgactttagagtgttgtttatctggtgttaaattaatcaccaaatccgccgtaggaattaattgctgataagttcctacaacaaatccgttttcacttgctcgctgaaaagaagcacgtttttcctcaatagtttccggacgaagagcataagcaatatccaaaccggaatctcgcatatttaaaccttgatttaatccttgagcaccacatccgataatgacaatttttttaccttttaagaaattaaccccatcggcaaattcctcacgatccataaagcgacaacgacctaactggtcaagttgttgacgcaaatttaatgtattgaaataattacccatttccaatctccttatgtaatattccgctggttataaccaaattaaaatttacggtaaaagcattatacataaatttgctattgcgtaaattgactttattgaaaacttttatttcgttttctcaaatagatctgtttttgtttgtaatttatttttttaatttaaagtagtatgaaaaaacagtataattaaggggttagttaattttttcttaacttcttaattttaagaataatttcttttttgggggaataatgagaatatttaaatcaataaaacaattctttgttaagccatctgcaaaaatagggttaggtatccttttggtcggcggtgcctttgcaggaattgtaggttggattatctttaatgccgttcttgaccataccagtcaagaagaattttgtataagttgccattctatgcaatatccattagaagaactcaaacaaaccgctcattggtccaatgataaaggggtttccgcaagttgccctgattgtcatttacctcacaatacggtggataaatatattcgtaagattcaagcaacaaaggaaatttttgccgaattaagcggtaaaatttcttcgaaaacagactttgaaaaacaccgtctagaaatggcagaaagggaatgggcgagaatgtccgctaacggttcggcggaatgtaaagcttgtcacagctatgatcgaatggattttgataaaatgtcggagattgcacgcaatgccatgatacctgcagctgaaaaagatcaaagctgtattgattgccataaaggaattgcacatcatcttcctgaaatgtcacattcatcatcaaaaggcaatggtttaccatcaagctctttacaagcaaataaaatctattatacggaaaataatgtcgctctttttgcagatgaaacaatggggcaagaaatcgggcagttagaaactggcgtaccagtacattttgtgaaaacaacaccaaacgcggatttggttgaactggaaatgtggcgaaaagacaaaggctttggacgaatttggtataaccaattcggaaaaaatattaccgatgccatactaactaaagaatttatgtcggcggagcctaaatatgatgtattggaaagtgttgaagatcctattaccggtctaacttggcaaaaagtaaaactttctgtatggattggtaaaaatcaacttattgaaaatattgataatttatgggctgaagcggaaaaaatttataaaacgcaatgtagtacttgtcatagacaacctgatgtaaaacattttgattcaaatacttggattggactgtttaatggtatggtcggttttactaatattgataaaccaacaggaaaacgtgttttacgctatttacaaatgcattcatccgattttcaaccacacgataataatcattaatgaggaataaaactatgcaacaatcacgtcgtcaatttttgaaaaatatgtctgttatggctgcgacttttgcaatgcctaacttcctcgttgctaaaagtgcggtggaaaataaacaagatttatcacaatggaaaattaccggctcccattggggtgcaattcgtgccaaagtcgttaatggtcgagtaagtgaaattaaaccttttgagtatgatgaatacccaaccgagatgataaaaggaatcaaagggttaatttatagcgaatctcgcattcgctatccaatgatacgattagattggcttaaaaatagacacaacagcaatacagagcaacgaggagataatcgctttgtacgtgtgacgtgggacgaagcccttgacttattctatgaagagttagaacgaattcaacaaaattacggaccttgggctttgcatacgggtaacgtaggttggcgttcaacaggacaattccacagctgtggtaaccatatgatccgagcaatcggcatgcacggacacagtgtcagtactgccggagattactctaccggtgccggacaaattatcatgccttatgtgttaggctcaacagaggtttattctcaaggaacatcatgggagattttacttaaagagagtcaaaacatcattttttgggcaagcgatccggtaaaaaatttacaggtcggttggaactgtgaaacccatgaagcctataaatatttagcccaactcaaacaaaaagtagcagataattcaattaatgtaatttgtgttgatcctgtgaaaagtaaaactcaaaattatttgggttgccaacaacaatatatcaatccgcaaactgatgttccttttatgctcgccatagcctatgtgctttatacggaaaatctttacgataaaaaattccttaaaatgtacacgataggatttgaaaaatttgtaccttacttaacgggtgaagaggaagacaaaacagcaaaaactcctgaatgggcagagaaaatctgtggtatttctgcaagtaaaattcgtgagtttgcacatatgcttgccggaaaacggacacagttaatttttggttgggctattcaacgtcaacaacacggtgaacaaccttactggatgggtgccgtcttagcggctatgctcggacaaatcggtctaccgggaggtggtatcagttatgcccatcattatagttccatcggtataccggaatccggagcagccatgcctggtgcttttccattgaatgtggatgaaggacaaaaaccgaaatacgaaagcaccgattataacggttatagtgcggtcattcctgtagcaagattatccgattccttgttaaatccggataagacaattcattttaacggacaaaaagtggtttatgctccctataaaatggcaatcttcaccggatgtaaccaatggcatcgtcattctgaacgcaataaaatgaaacaagccttccaaaagctggaaaccatagtatcaattaattacagctggacagctacttgtcgtttttccgatattgtgttacccgcctgtacgccttttgaacgtaatgacattgatgcttacggttcatatagcaaccgaggcgttattgctatgcaaaaattaatcgatccgctttacgattcccgttcagattttgaaattttcaaagaactttgtcgcagatttggtaaagagaaagaatattgtcgtaacatggacgagatggaatgggtagaaaaactttacgaagactgccgtaaagaaaatgaaggcaaatttgctatgccaacctttgaaaaattttggaaaacaggatttgtacttttcccggaaggtaaaccttgggtaagacatgctgatttccgagaagatcctgaacttcatgcacttggtactccttctggttttattgaaatttatagcaataaaatcgcttcttatggctatgatgattgcaaaggtcatccaatgtggtttgaaaaaacggaacgttctcatggcggaccaaaatcagataaatttaaattctggttgcaatcagttcaccctgatcaacgtttacattcacaactttgtgaatcaaaagaattacgtgaaacttatactattcagggtagagaacctttatttatcaatccaaatgatgcaaaagaactaggcattgctcatggagatcttgtgcgagtttataatgatcgaggtcaagctattgtaggtgcacacctttcagaggactatccaagcggtgtagtgcggttacaagaaggtgcatggtattcaccgttagatgaaaaaatcggctctattgatacttatggcgatccgaatactatgactcttgacataggttcttctagcttagctcaagctgtttctgccaatacatgccttgttaatattgaaaaatataaaggcattgctcctgaacctaatggtttcaaaggtccaatagaaattgcattatgataacgttgaataccgaagaaaaaatctttatttattcatggcttaaaaatatattaagccatgaattaactgaacagcagctacaacaatatcaacaaggggtttttactcccttgtttgattttttgtcagaacaagatttggcgaagcaaataaatactgttcgaaactcactcatgcaattatctaatttgcctttagctcatttagaattagctgcggattttgcccaacttttcttgttgaatggagaaaatagtgctttgccttacgcctccgcttacttatcggaaaaagaactaaatcaacatattgcatttattgaccatttactatttaaataccagctaaagtttgatcacaatctacgtgaacccagcgatcatctcgctgtttatttagaattactgataacccttgaaaagagcggtcaaaaagagaaaagttttaactttattcaacattatttattagcttggcttattccttttaataaaaaagtacaaaaaattaaaacagaaacctcgttctaccaagccataacagaaatattaatcacgctgttaaataaaaatgtaaaactctcatagcatttaacaaaatcatcaacaaattagttagtgatttttatgccggatataaaaaagctaatcttaaaagattagcttttactttatttaatttgcctttcaatcacaccgccaccgagacatacctcaccttgataaaaaacagctgattgtcccggcgtaacagcaatttgtggctcatcaaaccgcacttcaatacaatcatcatttataggaataacttcacaatcaacatctttttgacgataacgtgttttgactgtacaacgtaaattttgacgaattggcaaacgatcaatccaatatagctgagtagccattaaaccttgtgataacagggcagaattatcatttccttgtgcaactactagtacattgttaattaaatctttttctaccacataaaacggatcttcacttaacccttttactcctccaatacctaatcctttacgttgacctaaggtgtaatacattaagccatcatgtttgccgatgactttaccgtcaaccatacgaatttcacccagttgtgcaggtaaaaatcttgccaaaaattctttaaatttacgttctccaataaaacaaatccccgtagaatctttcttttttgccgtaatcaaaccgagatcttctgctatagccctaacaatcggtttttcaatttcacctacgggaaatagactttgagccacttgatctttgctcaaggtataaaggaaataactttgatctttattactatccagaccacgtaataattttgtttgtccatttacatcggatcgacgaacataatgtcctgttgcaatgtaatcagcacctaaatcttctaccgcatattccaagaaagccttaaatttaatttctttattgcataaaatatcaggatttggtgttcttccggctttatattcagctaaaaaatgctcaaatacattatcccaatattcagcagcaaaattaattttatgtagctttattcctaatttatcacacactgcctgtgcatcagctaaatcgttagcggcagtacaataatccgtatcatcatcttcttcccaattcttcataaacaatccttcaacttgataaccttgctgttgaagaataaaagcggacacagaggaatcaacaccaccagacataccgcaaatcactttctttttactatttttagcaatttcaagtgcggtaagttttggtagttttttttcataaacaatggatttcatatttttatttatttttaataatcaagttaattttttattgaaggtaatttttagataaaaacataaatacgctttcatattgcgaggtgtttacatcaaacatctgtaaaaatctgtcagccgcttttctatctgcaatttctttttgaacaaatcgttcaaaatctttcttcaaactgtgggaaaaagattttctcatattaataaatttgactaataatgtatgagaataataaccttgctgaaaaatatcctttaaaatattgtcctgctcgatcattaatttgttaatattatcaaattgttcttcaataattttcttatcttctgtggaactaattttctctgaaattttccatttctcagccaaaatttcatctaacttaataaaattatactttattttttcagcatccttcactggtgcaataagtgcataacttgaaccatcaatctttatttcctttgggttagtcttcttttctacagcgaaagcaatagaaaaaatttgagaaattacaagtatcaaaaaaagtaattttttcacaaaagcttctccagataaaaaatatcaagaatattaacgttatttcaactcataaaactgcggttgttttttcgcaaatttttcttcatattcagtttttgcatcttcatcaccagcagcaagtttagcctgcaagttatcacatggagtatcacaatcacagacttttttcatccctaaagcagatataccaccacaacttccagcaatggacttacgctttatgatataaccaagagacatacctaaaataactaaaacaaaaatagcaaaagtgactaaaaataatttcatagaaactccttattttttctgagttgataatatttcagcaaatttagaggacattttattttcaaacccttgtggagttttgaccgttaaataaataggtaaatcattttgctcagcaatttccagtgctttttccgcacctaaaacaaataaacctgtggataagccgtctgcagtcatagcacttttagataagactgtaattgaggctaaattatgctgaacgggctggcaagttgtaggatctatttcatgggaaaaacgttttccatcttgctcaaaataattgcgataatccccggaagttgccatagccaaatcttgtaaaccgacaacttgtgatacagatcgagttccatcaaaggttggcttttcaatagctatttgccaagctttattttcagcattatgaccatttgctcgaatctcaccgccaatttccactaagtagtcagtaataccttgctcagcaatataatcagcaactttatcgacaccaaaacctttagcaatagaagataaatcaatataaatctgcggcacagatttggtcaaaaagaatttattgtctttttgtgttagtctaactttctcaatacctacccaggcttttcgttcagctatttgctccggtgtgggtgctttttctacccgtttttccggtccaaacccccataagttcacaataggaccaactgttacatctagagcaccttgagtaatttgatttaactttattgcttcagcaactacaaaagccaaatctgcggaaatttcaataggattatttatctccttgtttttgttgaacacacttaactctgaattaggaatataagtggacattttagcatttacatcttgtaagataccttcaatgccttcgtgcattttttgtactcttaacttagtcttgccattatcaatatatttgatatggtaagttgtacccatggttctaccatttaatgacactaactcagcttctttttggcaagcactaagtaaaaataccaacgcaaatatatttattaaatttaataataatttcttagtcataaagtgcggtttatcctatttataagtttttactaaaggttcatcagcctttttaatatcaatatgacaatagccattaggattttttaataaataatcctgatggtattcttccgctggatcaaatcgttgtaaaggcaacacctcaacaacaattggtttactgtattttttctgttcttgtgtaagagcggttaaaataatttctctatcctgtggatcggtatagtaaatacctgttctatattgtgttcctttatcattaccttgttgatttaaactagtaggatcaattactcggaaataatattgcaaaatatcctctaaacttaatttattttgctcatagatcactttaaccgtttccgcatgaccagtattattgtataacacatcttggtaacttggattttcagttttaccatttgcataacctgaaatagcatccaacacaccatcaatacgatgaaaatagccctctactccccaaaaacaacctcccgcaagataaatagctttgttgctcatacgtaattccctttatgcaagtataattagtttaaataaaatacaaagcggtcagcttcaaaaatttatgaaatctgaccgcactttattgatcatttaagatcagccaccaaaatcatctaataagatattttcatcttcaacaccaagatcttttaacatcttaattaccgcagcattcatcaccggaggtccacacatatagtattcacaatcttccggtgcttcatgatttttcaagtagttttcataaagaacattatgaataaagcctgtgtaaccatcccaatcatcttcaggaagtggatcagaaagagccacatgccatacaaagttatcgttttcggcttgaagcatatcaaaatcttccacatagaacatttcacgtttagaacgagcaccataccaaaatgacattttacgttttgattttaaacgttttaattgatcaaaaatatgtgatctcattggtgccatacccgcacccccaccgataaagaccatctcattatcagtttctttagcaaaaaattcaccaaatggacctgaaatagtaactttatctccttctttcaaagaccaaatgtaagaagacatttgacctggcggtacatcaggattacgtggtggaggtgttgcaatacgaacatttagcattatgatacctttctcttctggatatgaagccatagagtaagcacgaataatatgctcgtccacttttgaagtataacgccataaatcaaatttatcccaatcttcgtggtattcttttggaatatcaaaatctttatagtgaacagtgtgtggttctgcttcaatttggatgtaaccaccagcacggaatggtacttcttcaccttcaggtatttgaagtttaagctctttgataaaagttgccttattgtcattagaaataacagtacattcccattttttcacaccaaaaacttcttctggtaactcaatcttcatactgttcttcacatttacttgacaagaaagacgataaccttctttagcttcacgctttgaaatatgtgaaagttctgtcggcagaatatctcctccaccttcagtaactttcacgatacattgaccacaagaaccaccgcccccacaagcagaggatacaaagatacctttatttgccaatgcacctaataatttaccacctgctggtaagttaatagctttaccaggatcatcattaatttcaatagtaatgtcccctgaatttaccaatttagatttagcaaacaaaataagtacagctaaagctaaaacgataacagtaaacattgcaataccaagagtaatttccatttaagtatcccctattacaactgaacaccggaaaatgacataaacccaagagccattaagccaacagtgatgaaagtaatacctaacccacgaagacctgccggaacatcagcatatttcattttctctgtaataccggcaagagcaactatagctaacatccaaccggtccctgcaccaataccataaacaacagactcggcaaagttatagtcacgctgaaccataaaagataccccaccaaagattgcacagtttaccgtaattaaaggaaggaaaatccctaatgcgttataaagtgcggggaaatatttgtctaaaatcatttcaagaatttgaactaatgcagcaattaccccaatgaaagtgatgaaatttaagaaacttaaatcaacaccatcaattaaagctccatctttaagaatgagagaataaaccaattgatttacaggcacagaaatacctaatacaacagtcaccgcaacacctaaaccaaaagctgttgatactttctttgaaactgcaaggaatgtacacataccaaggaagaaagaaagagccatgttttcgataaatacggattttacgaaaaggctaatataatgttccataaattatttctccacctgttccggtttccatgttctcagaccccaaataatgaaaccgataataaagaatgcacttggtgctaataagaataaaccattggtttgataccatccaccatcttggatagtttgaaaaatagtcataccaaataatttacctgaaccaattaattctcgaataaaagcgacagtaactaaaattgctccatagcctaaaccattaccaataccgtcaacaaaactttctattggtgcagatttcattgcaaaagcctccgcacgtcccatcacaatacagtttgtgataatcaaccccacaaaaactgaaagttgttttgataacccataagcatacgcacgtaaaatttgatcaaccaaaattactaacgaagcaataattgccatttggacaattatacgaatactgttcggaatataattacggattaaagaaataaaaaagcttgaaaaagctgtaacaagacttaccgcaattgccataacaactgctgtttcaagtttggttgttaccgccaacgcagaacaaatacctaaaatttgtaatgcaatcggattattatcagtaatcggtgataataataactttttaatatttgcatttgccattagttagcccccttttttagttttgctaaatatggaccaaagccattagcaccaaaccaataatcaaacgtaccttgaactcctttagaagttaatgttgcaccggaaagactatcaattccatgttgtgcatcagacgatgcgcctttacctacacgaatagccggttgattttcttcatcaagcagtaatttaccaacaaatttagcttgccattttggattttcaatttcgcctcccaacccaggtgtttcaccatggtcatagaatgtaatacctttaattgtattaccatccggttgaattgaaacaaaaccatacattaccgaccacaaacccgtaccatacacaggtaaaacaatttggtttatctgattgttctcatctttaacaagataaacttccgctaatttagcacgttgacgtaaaccagctttatcatcttgaggggcaatagaaacattttgagcggaatctttcgctgcagattttgcatcaaaaccggtaggacattttacataatcaccagaatttaattccacacaacgagcttcaatattcttagtaaaaatatctttaatttgaccggcttttgtatctttttgcaataatcctgcaacacttaaaatatttttttgcttatcaagttgtttttgttcttcttgtgttggttttaacaataccgcagaaccagcaacaataacagaacaagctaaactcaacagaacaacaatcgaaattgttcctccaacactatctttattaaatttagccattgcgagatctccgacgtttaatatttgcttgaacaacaaggtagtcaaataacggtgcgaataaattagcaaataaaatagccagcatcataccttcaggatatgctggatttgccacacggataattacagccatcacaccaattaatgcaccatataaccatttacctttattagtaaatgcggctgaaacaggatctgttgccataaaaaacatacctaatgcaaaaccgcctaatacaaaatgccaataccattgcattgcaaataatggattagtttcagatccaataatattgaataaagttgaagttgcaatcataccaatcatcacaccagcaataatccgccaagatgcaattcgagcaaaaacgataattgcagctccaattaataaagcaaaagtagaaacctcacctatagaacctggaatattacctaaaaaagcatccatccaagtaataggctcgcctgttgcaacatgttttaatgcaacttgtccacctgcagcccattgagaaagtgcggtcgcaccagagaagctatccgcagctgtccaaaccaagtctccagaaatttgagccgggtaagcaaaaaataaaaacgctcgacctgctaatgctggattcatgaaattcttaccaacaccgccaaacacttcttttgcaacgacaacaccaaaggttgttgccaatgccgcttgccataatggtaatgtagggggaacaatcaatgctaataaaatagatgtaacaaagaaaccttcattaatttcatgtttacgcaccattgcaaataaaacttcccaaaatccaccgaccaaaaagacagttatgtaaattggtaaaaagaaaattgcacctaatgccattttagctaaaacaccagcatcaatagacactaaaccaagcatgtttgctaatgcaaagtgccaatcattagctacattttgagctaagtttgcagaaaaatcaccaacacttaatgcaagaattgattgtgcaccaacattatacattccgtaaaacattgcagggaataatgcaagccaaacaagcaccatcatacgttttgagtccaatgcatcacgaacatgtgaagatttacctgttactgtacccggcgtatataaaaatgtcgctgtcgcttcgaacaatgcataccatttttcatatttaccacccggcaaaaaagcaggttccattttctctaaaagatgttttaaacccatttttaaccttccttctcgatcttatctaatgctgcacgtaacatcggaccatattcatttttacccggacaaacgaaagtgcataaagccaaatcttcttcatccaattcaagacagcctaaagcctgtgcactatccgtatcacctgatgctaaatcacgtaataataatgtaggtataatatctagaggaacaacacgctcatatgcaccaatcggtaccatagcacgatggccaccatttactgcggaagtaaaattaaataatttactgctgaaatgtcctagtactgttcgagtaatggaaaatttgttttttccaggcataatccagcctaaaaattctttctcacgaccttcagcaataacagatacttgcaaagcataacgtcccaaatagttatatggaccgattgctgtattaccacttaacactgaaccggaaataactcgattttcacccgcacttaattcattttccgttaaatgtgaaagatttgcacctaactgcgtacgaattaaacgaggatttttaacttgtggtccagctaaagaaaccactcggtcagtataaatttcacctgtagtaaataatttaccgatagcaataacatcttgataatttaaataccaaactgatttagttgcactaacaggatcaataaaatgtatatgtgtaccacttaatcctgctggatgtggtccactaaaatcatgaacagctaagttaggtaaatcaatcgttgggatattactatcaccagctttacacaaatgtaatttgccttcatgtaaacgacttaaaacggttaatccatcagtaaaatcctgccaatgttcttttaaaacaatttcaggatttgctgataatggatttgtatccattgcattaacaaaaatagaagaaggtaccgcatcactcgcaggtactttactgaaaggacgcgtacgaagtgcggtccataaaccagaagattgtaaattttgacgaacttggtctgaagtcaattttttcaattcatcttcattatattgagtaaaggtaatttgttcattaccttccactttaattaccacagattgtaaaactcgcttagcaccacgattgatcgcagttacagtaccacttgcaggtgcggtaaatacaataccaggattttttttgtcttcaaaaagtacctgaccttttttcactacatcaccttcacgcaccttcatcgaaggtcgcatacccacatactcttcgccaagcaaagcaacttctttaacagcattgccgttatggattacttgttctggttttcctgcaataggaagatccaagccttttttaattgtaatcatattgtttgcactacttttcgttagattaaaatatagttgtaacaaaaaagtaacaaccgcgtcttgagtaatgatttcagccgacgaactactaaaaatcaatttatccgcatcaatcacataaaaataaaactcaaattctgttttttactgtacctagcttaatgatagaaacaataaattaaaaatttactaaaaatcaacgagtcattttaactaaataatgactccgattccactttagacacctttttttatgtttttttatgaaatttttgatctatttttgtaaaaaaatcaattctaaaccaaaatattgctaaagagttactgaccaatatctgaacaattaggcgactttggaaaaactttgcctaatttttcccattcttcaggactatataaatgtaaagctaaagcatgaataccttgttgtaactcactactaaacaatgagtaaactaaacgatgacgagcgacttttgtcaaggatgaaaacctattgctcacaacaactaatttaaaatgagagttagcacctcgacctgagctgtgcatataactttcattttctatctgtaaaaagtgcggtgaaaattcttgtaatagctttttttctaggactttttgtatcgacataagtttatccttatttttactatttgatatttgatgtataacactatattttcattaataaaaaacagattttatttttatcttacatcaaaaatagatttttttattactcaactctgtttttttattgcatactctttcattacatcaacaaaaaaccgccttttggcggttttttatttataagattaacgttttctttgtgttaaacgatctgttaattcataagcacgtaattttgccaattctcttgaaagtttagataccaacatttcataattagcatctttggcaccagaaacaatattttgttcagccttacgtttcgcctccaaaatacgttctctatcaagttccttaccacgaatagcaacatcagctaaaacagttacaattgttggttgaacctccaaaaaacctcctgaaatgtaaataacttcctcagtatcatcttcaagagtaatttttataatacccggcttgatagcggtaagtaagggtaaatgtccggctaaaatacccaactcaccttcagaacctgtagcttgaatgcctttaacttcaccattaaaaatatgttgttctgcacttactacgattaatttaaatgtcgccatctttttctccttcaagtttgctgttaatcagtcttgaagtaactacatttttttggctttttctagcacttcttcgattgagccaaccatatagaacgcttgttccggtatatgatcgtattcaccatctaaaatacctttgaaaccactaatagtatcttttaatgatacatatttaccaggagaaccagtaaatacttctgcaacgaagaacggttgtgacaagaaacgttctattttacgtgctcgtgctaccactagtttatcatcttcggaaagctcatccataccgaggatagcaataatatcctttaattctttatagcgttgcaaaataccctgcacacctcgagctacatcataatgttcctgtcctactactaatggatctaattgacgtgaagtagaatccaaaggatcaacagctggataaatacccaaagaagcgatattacgacttaacaccactgttgaatccaaatgagcaaaggttgttgccggagaagggtctgtcaagtcatccgccggaacataaacagcctgaacggaagtaatagaacccgtttttgttgaagtaatacgctcttgtaaaacacccatttcttctgctaatgtcggttgataacctaccgcagaaggcatacgacctaaaagagcggatacttctgtacctgccaaggtataacgatagatattatctacgaaaaataatacgtcacgaccttcatcacggaatttttccgccatagtcaatcctgttaaagcaacacgtaaacggttacccggcggttcattcatttgaccataaaccagcgatactttatctaatacattagattctgtcatttcatggtagaaatcattaccctctcgagtacgctcacctacacctgcaaatactgaataacctgaatgttcgattgcaatattacggattaattccatcatatttacagttttacctacaccagcaccaccaaataaaccaactttaccacctttagcaaaaggacaaattaggtcaataactttgatacctgtttctaaaagttctgtactatttgattgttcttcatagcttggtgcagcacggtgaatagcccaatattcttccgcaccaatttctcctttttcatcaataggctctcccagaacgttcataatacgccctagtgtttttgttcccacaggaacagaaattggatttcctgtattttctacttttaaaccacgttttagaccatcagatgaacccaatgcgatacaacgtactacaccgccacccaactgttgttgaacttcaagagttaatcctgattcaacttttaatgcatcataaacttttggtactgcattttgtgggaattcaacatcaattaccgcaccgataatctgtataatttttcctgctgacattaccttatctccattaaattgctgctgcacccgcaacaatttcattcaattcatttgtaatacttgcttgacgagctttgttatacaccaactgcaagtcattaattaaattacctgcattatctgttgctgctttcattgctaccattctagccgcctgctcagaagccaaattttcaacaaccgcttgataaacttgagattccaaataacggactaataaactatccaacaaagtttgaggatttggttcgtaaatgtattcccaattatcactatttttgcctaagctatcattatctaattccggtaatggaacgagtttttccattattggtttttgcgacatcgtattgataaacttattataagtaacatagattgcatcaattttaccttctttataagcctcaaacatacgatttgctataccaattaattcttcagctacaggggtatctcccatacctgaatgctgagctttaatatttaaaccaagagattggaaaaaacctataccttttgctccaattaaacctaatgaaacttcaacattttgttctttccagttttttatttcagaaagtgcggtcttaaataaattaacatttaaaccgccacataaacctctatcggttgaaataattaagatgccaacgtttttaacttctcgttcaatcaaaaatggatgttgataatcaatattggcttttgatatatggctaattacaccttgtattgctttagaatacggacgtgaagacgacatacgatcttgcgttttacgcattttcgatgctgcaaccatttccattgctttagtaattttttgcgtactttgcacactggatattttggttcttatctcttttgcaccagccattttatttctccgttaattaactattaccatgcaacatttgctttaaattgatctaaaacggttttcaatgtatttttaatttcatcatcataattaccagttttagtcaactcagccataaaatcagcatagttgtagtttgcatattctaaaagtgcggtttcaaaagtacctatacgatttaattcaacgtcatctaaataaccaaattcaacagcaaataataccaaagcctgttcagcaacacttaacggtgaatactgtttctgtttcaataattcagttactttttgtccatgtgataattgtttacgtgtagcttcatcgagatctgatgcaaattgagcaaaggcagctaattcacgatattgagcaagtgcggtacgaataccaccagccaattttttaactactttggtttgtgccgcaccacctacacgagaaaccgaaatacccggattcactgcgggacgaatacccgaattaaataaattggattccaagaaaatctgaccatccgtaattgaaattacattagttgggacaaacgctgaaacatctcctgcttgagtttcaataataggaagagcggttaaagaacctgtttttcctttcacttcaccttttgtgaatttttctacatattcttcactcacacgagaagctcgttcaagtaaacgagaatgaagatagaatacatctccaggaaaagcttcccgacccggtggacgacgtaaaagtaatgaaatttgacggtaagcaactgcttgtttagataaatcatcgtaaacaattaacgcatcttcaccacgatcacggaaatattcacccattgcacaacctgaatatggagcaaggtattgtaaagctgctgactcagatgcagaagctacaacaacaatagtattttgtaatgctccatgttcttctaatttacgtactacgttagcaattgttgatgctttttgaccaatagcgacatatatacattttatacctgaatcacgctgattaatgatggcatcaatagccaatgctgttttacctgtttgacggtcaccgataattaattcacgttgaccacgaccaataggaaccattgagtcaacagccttataaccagtttgtacaggttgatcaacagatttacgttcaattacacccggtgcgataacttctaccggtgaaaaaccatcatttttgatttcacctttaccatcaattggctgtccaagggtatttactactctacctaataaccctcgaccgaccggtacttcaagaatacgacctgtacactgaacttccataccttccgctaaatcagagtaaggtcccatcactaccgcacctacagaatcacgttcaaggttaagtgccatggcataacgattacccggtaatgcaatcatttctccttgcatcacatcacttaaaccatgtatacgaataattccgtcacttacagaaacaattgtccctgtattacgtgcttcgtttatcacctcaaactgagctatacgttttttaatcaattcactaatttctgtcgaatttagttgcatattttattcctcttacaatcgcaactcatttgctagacggttgatttgtccacgacaactaccatcaataacaaaatcatttgtacgaataatagctcctgcaattaacgaactatctattctgcaatttaatattactttacgagcaagtcttttttccattgcggtaataattttctgttgctgtgcatcatttaactgttgagcagaaataacttcaacttgtgatagagatttatattcttcaacataagatttaaactcgttaaatacagctggaagtacagctaaacgcttattttcagccatcaacctaactaaattttgcccatattgatcaagttgttcgccacaaattgagataacagtatcagcaagtttaaaagtagaactagtgcttgttaagtaagtttgaactttatcatgacgaataagcccagacaaaaactctaacatattagcccatttttctaccgcacttttatctttttcagactgctctactgcaaaatcaaataccgctttcgcataggggcgagctatcgtagttaattccgacatagtctcaaccttcctataaatctgcaactaatttatcaataatgtcattgttcgccgcttcatcaatgttgcgacccacaattttctcagcaccggcaatagcgagagatgcgactttaatacgcaactcttcttgaacacgtttacgttcagattctatttctgcatgtccctgttcaataattttctctcttaatgcctcagcttcaattttgacttcttccaaaatttcattgcgacgtttattcgctagatccactatttcctgagctttaattctagcttgattaatttcttgctcaactaaaacctttgtatcggattgctcttttttagcagcttcagccgaagctagtgcatttgcaatagatctttgacgttcttctatagctttaataatcggtggccatacatatttcatacagaaccacacaaaaatagcaaaagcaatcagctgacctattaatgttgcatttaagttcacaatgccctccctaaaattggatttattcttctaaagaataatatgattatttatccaactttaattagtttaataaaccaatgaatggatttgcaaaaataaatagtaatgcaatacctactgcaatcattgaaatagcatctaaaagaccagctacaataaacatttttgtttgcaagctagctgctaattcaggttgacgagcagatgattctaagaatttaccgcctaaaagactaaaacctatagcagtaccaagtgcagcagctgctaataaaattacagaaccaaaaatagttgcagtaataatgttttccataatattctcctatagatgtagataaaagtttagccaaaagctaagttgttaaaaaatcaatcgaaaatgtttagtaaaaataatttcataaaacagatttaatgatctgatttattataagctatacttagatatactacagtcagcatcataaaaataaatgcctgtaaagtaataactagaatatgaaaaatagcccaaattaaatgcaaaggaatacctaatacttgcggaataatattatctgccatatacataacagcaataaggacaaaaataagctcccctgcgtacatattaccgaataaacggaaggctaatgaaataggcttagccaaaagggtgactgcttccaataaaaagtttacaggaataaatgcccaatggttgaatggatgtaaggtatattcttttacaaaaccgcctaaccctttagacttaatcgtgtaaaaaataattaatgcaaacacacaaacagacatacctaatgtcgcactaatatcggctgtaggaactgctcgtaaataatgaatacctaataactcggcaaactgcggcggaaaatcaacaggaatcaaatcaatagcattcataataaacacccaacagaatattgttaatgccaatgatccaatttgatgacgaacatcacttccgtgaatattatctttaacaacaccatcaacccactcaactagcatttcaactaaacattgaaattttccaggaactcctgatgttgctttactagcaatacgatagaaaaagaaaaggaacaaaactccagatactaaagaaaaaaataaagtatcaagatggacattccaaaaaccttgtccggtagttaagaatgttaaatggtgactaatatagtcagcagtagtatggccagccatagttaatcctttttaaaactaaattttaaggtatttatttaccataaaaggcaaaagattattcaatacaatacttataagataacctacaaaaaaaactttaaaatcaaccttaaatgttttaaaaatgaatacaaccaaaataattgttaagataaacttaatcaattctccactataaaacatttttaggttatttttatactttttgttagtaaaaaacattaagtacacaaaaaggcaatatggaataaaaactgaaagtgcaccaaataagaaagataaatacacttcatgatcactcataccgcctatactcagtaaaacaaaagaaaacacaaaaataaaaaactcaattaataatgaagttttatatcttttttgagttttttttattacagcagacatcttatcgttctaatttgctacttacaaaaatcttgccagttacaagcctatttttgcgaatttttaacttaaaatcattttataaatgacagtttcgaccatattataaataattcattaaatttattctaatcttttttaacaaaactaaatgacgcttaccaactaattcaggaacattcaattctatgattttatccacagaaaattgagcagataaagccgaaacttcttccatattatattgaccttttaaagcataaaaaaaaccttgatccgttagtaaatgttgacaccattccgtcatatcttttaaagatgcaaaagctctacttaaaaccccatcaaattgatgatcaggtttaaattcttcaactcgacttaaaacaggttcaacattagttaattcaagttcacgaactgcattacgaatgaaactaatacgtttaccgagactatccaataaaaaaaactttttgtcagggttaattatagctaaaggtaatccaggtaatcctgggccagttccaacatcaataaaaatatttccttgtaaataaggacttacaacaatactatccaaagtatgttttaccaacatttccatgggatcacgcacagatgttaggttataagccttattccatttgtttaataataaaaccagctgaactaaccgctctttttgtaaattagtgggtaaaagagcggtattttttaacaaaaaatttagtttttccattaaattcttttgtaaatcagccattattcacctcgtttcagcataccttgtttttttaaattaacgagtaaaatagaaatagctgcaggcgtaatacctgaaattcgactcgcttgaccaatagaaattgggcggtattgttccaacttagcacaaacttcattggataatcccgatatatttttataatcaaaattagcaggaatagccgtattttcatggcgtttttgacgctcaatttcttcttgttgatgttcaatataaccttgatatttaattgcaatttcaacttgttcaacagcttctttgtcttccattgccggtttaaaaggagtaagtgcggtcaaaatttgataatttatttcaggacgacgtaataaatcttccccatttacttcacggataagtgggctttttaatatttcattagcctcatttaaatattcagaacgaggatgcaaccagattgaacgcaaacgttgacgttccagttcaatattttccattttttgattaaatcttgcccagcgaatatcatcaattaatcctaattttcttgcaattgaagttaaacgaatatcagcattatcttcacgcaacaataagcgatattctgctcttgaagtaaatactctataaggttctttagttcctacagtacaaagatcatcaaccaaaacccctatataggcttgatctctacgaggaaaccaactttctttttcttgaacaaataaacctgcattaataccagctaataaaccctgtgcagcagcttcttcatagcccgttgtaccattaatttgaccagcaaaaaataaaccagaaatagcttttgtttccaaagttggttttaagtctcttggatcaaaataatcatattcaattgcataacctggtttaacaattcttgctttttctaatcctttcattgaattaacaattttcatttgaacatcaaacggcaaacttgttgaaataccatttggataaacttcattacttgttaaaccttccggttctaaataaatttgatgagaattacgatcagaaaaacgtattactttatcttcaatagatgggcaatagcgtggtccaataccttcaataactcctgtatacataggactacgatctaaatttttgcgaatcacatcatgcgtttgatcattggtatgcgttatatagcaaggaatttgctctggatgttgttctacagatcccataaaagaaaaaacaggtaatttttcatcgccatattgtttagctagaatatcaaaattaatagtacgagcatcgatcctcggcggcgttcctgtttttaagcgatttactcttaaatttagatccctaagttttttagcaagatttacagatgcaggatcacctgctcgaccaccagcatagttttctaatcctatgtggatcttaccggctaaaaatgtacctgcagttaatactactgactttgccctaaattttaatcccatttttgtttcaacacctgtaactctatctttttctaaaataatatcggttacctcttgttgaaaaatatctagattaggttgattttcaagagcaatacgtacaacttggcggtaaagaacacgatctgcttgggctcgtgtagctctcacagcaggacctttgctactatttaaagtgcgaaattggatacctgctttatctgcagcagttgccattaatccgcccatagcatcaatttcttttactaaatgtcccttacctattccaccaatagccggattacaagacatttgtcctaaagtatctatattatgagttaataaaagcgtttttagtttcatacgagctgtcgctaaagcagcttctgttcccgcatgtccaccaccgattacaatgacatcgtaattttctgtataaaacataatagcctaagtgttattaaaggttttagagttcaaaatagcgatctattctacattaaattacaagataaacaaaaagaagaaagaagtaaaagatcatcagttgatcttcttcctaatataaatagaatctttttatatataaaagtattattatgtatattattaggatctttttttttgttaataagtatttttttattttttaaattaataagttggatcttttttttattgttatgatctagatcttttacagtaaaagaactgtggatatttttatgatttatccacaattctttttaaataaaaaatttttttatcttaataacaggaaattttttgttttttattaaagttatccacagagtaatgtaaattaattgaataaatttagattaacattttttaaccagttttcagcaaaatgatcaggatcatcaacattcatgacatctatttttaaactttctgtaattcttatagcttttttattcagtaaagtgtcttcaatttgattcacagcatagcaaaaagtatcataatcggagcttcctaaaccaataacagcaaaacgtatttgagaaagatctaagtttttttgtgtaatttcttcaaataggggttttaagttatcaggtagttcaccggaaccatgtgttgaactcactattaaccaatttttatgtttaattacatcatttagtgaagggccatgtaatagattagtcgatatacctttcttatctagtaataattgaatatgttcggctacatattctgcacctcctaaagtacttcctgttagaatgcaaatttgtttattcatcttaataccttaattttagctaaaaaaataggcttagaattaatctaagccattgattttatgaatttaaatattatcaatacgacccaataatgaacgtaatcgttcttgccagttatgatgttctgtttttaagtgttcattttcgctacgtaattgctcattggtttgacgagatagctcatttttttcttttaattcttcaatttctaattgaagtaattggattgtttcaacagcttgtttaattttttcttctagttggtctaaaatttctaaagacataatggtttccttttaaataaaactaatttgcgtagttattctaactcagttgtctattatttttaaggaaatttatgaaaattttatatgttgtatggcattgtgtaatcaatccattatttgtaatagaaaatataccgctctttatgttttattggagtataacatcagcagtaagttgataaaaattagcctattaagcaaatttttgctataatccgagataatttttatttataaaaaagagaaattttatgtcagaaaatacaactgaaaattatggtgcaggaagcattaaagttttaaaagggcttgaagcagtacgtacacgacctggaatgtatattggtgatactgatgacggtacaggcttacaccatatggtttttgaagttgtagataatgcaattgatgaagctttagcaggttattgtaaagatattattgttactattcatgcagataactctgtctctgtgcaagatgatggacgtggtattcctgttgatattcatcctgaagaaggtgtttcagcagcacaggttattatgacagtattgcatgctggtggaaaatttgatgataactcctacaaagtttcaggaggattgcatggagtagggatttctgttgtgaatgccttgtcggataaattacaactcactattcgccgtcaaggaaaagtgcatgaacaattttaccatttaggtgatccacaggaacctttatccgttattggtgaaacggaaaaaacaggtacaactgtacgcttttggcctagtcccactatttttactaatattgattttgaatacgaaattttggcaaaacgtttacgtgaactttcatttttaaattcaggtgtatcaataaaattattggataagcggaataatcgtcaagatcattttcactacgagggcggtattaaggcttttgttgaatacttaaataaaaataagacaccaattcatcaaaaaatattttattttagtgcggaaaaagacgatattggtgtagaagtagctttacagtggaatgatagttatcaagaaaatgtttattgtttcactaataatattccacaacgagacggaggtactcatttagccggttttcgtggtgcattaactagggttttaaacaaatatgtagaagaaaattcgaataaaaaagacaaaaaggatatagcaacttcaggtgatgatgcgagagaagggttggttgctattgtttctgttaaagtaccggatccaaaattttcttcacaaacaaaagataaacttgtgtcttctgaagtaagagctccagtcgagtctgttatgagtgattatttacaagaatttttggaagaaaatccaaatgatgccaaaattattgtaatgaaaattattgaagctgctcgggcaagagaagccgctcgcaaagctcgtgaaatgacacgtagaaaaggtgctttggatatagcaggtcttccaggaaaattagctgattgtcaggaacgtgatcctgctttatctgaattatatcttgtagagggtgattcagcgggaggttctgctaaacaaggacgtaatcgtcaaaatcaggctattttgccattaaaaggaaaaatacttaatgtagaaaaagctcgatttgataaaatgttatcttctcaagaagtgggaactttaataaccgcacttggttgtggtataggcagagatgaatataatcctgataaattacgttatcatagtattattattatgaccgatgcagatgtagatggttctcatattcgtacattgttattgactttcttttatcgtcaattaccggaattaattgaacgtggtcatgtttatattgcacaacctcctttatataaagtgaaaaaaggtaaacaagagcaatacattaaagatgatgaagaaatgcaacagtttgagttaaatttggcattagaaggatcctctctttatgtaaatgaaaatgctcctgcaatgaacggaatagcattagaaaaacttatttcggaatataattcagtacaaaagatgattagccgtttatcttttcattatccagaaatattattgaaatcattaatttatcaaaaagcattaactaatgaaatgatgactgatgaaagtgcggttgatttttgggctaaatctttagttaatattttaactgacaaaaaaataagtggtagtagttacaaatatcgtattgtttttaacaatgaacgtcatttatatgaagtagttataattattcgtacccatggtatagaaaaaaattattttttgaattttgaatttttaaatggaactgaatatagccgtattgttaaattaggtaaccaactacagggtttattagaaaaaggagcttatgtatctcgtggtgaacgtcaacaatcggtttcgtcttttgaacaagctatcgaatggctgacgaaagaatctcgccgaggtctgattattcaacgctataaagggctaggagaaatgaattcagatcagttatttgaaacaactatggatccaaataagcgtacaatgttaaaagtatcgattaaagatgctgttgcagcagatcaattatttaccactttaatgggagatgaagtagaacctcgtcgtgaatttattgaaatgaatgcactaagagctaatttagatatttaattttattttttatttatcaattttggaattaatagaggtttttgatgtgtacagttatgcagaaagatgtattaattgaaatgattgctaatactatggctacgatcaatgtaataatagaacctaaagcagaaaataatgaggatcagaattatttgattaaattaaaaaatgatttgtatagtactcatcatgatgacattgattataatctcttatcaatgatagtgaagaatatcaaagataaatatataggtcagcctgttcataaatattatgcgtaggtgataagcataataaataaactcttgatttgtatgaatattatttgtaaataaaaagatccccttaaaaagggggatctttatttttttgttgttctaaaaaattgatgttctttaattaacgcaagaaagggttgagcaaaacgttttaatttaatatcgccgacaccattaatttgtatcatttcttgttctgttattggttggtattgtgccatttcttgtaatgttgcatcgttaaatactatataaggaggaatattttctttgtctgctatttttttacgcaaaaaacgtaatcgagcaaagagatctttatcgtaatttgtgaccgctctttttggtatagtaacggcattagtaatagaagatatccttggtgttgctaattgcaatggttgttcacctcgtaaaataggcaatgaatctaatgtgagttgtaatgttatattaaaatggtcaattacttgttttatcagacctaaatggattaattgtcgaataactgattgccaatattctctactacgatctttaccaatgccgaaaacgcttagtttatcatgttgatattctttaattttttgattttgggaaccacgcagtacagcaataatatacattgccccgaaacgttgccccactcgatagattgctgacatcactttttgtgcatcaaccaatccatcatattttttcggaggatctaaacaaatatcacagttattacaaggtttttgttgatattcaccaaagtaatttaatagaactaaacgccgacaaatttggctttcagcaaattcccctatggattgtaatttatgtagttctatttgacgttgcggtatatctggtttttctaaaagtactttttgtaaccaagcgtaatctgcaggttcgtaaaataagacagcttcagctggtaaatcatctcgccccgctcgtcctgtttcctgatagtatgcctcgatacttcgaggtagatcaaaatgagcgacgaaacgcacgttagatttattaattcccattccaaaagcaattgttgcaacaacaatttgtacattatcatgttgaaaagcacgttgaacaaattctcgttgctcattactcataccagcatgataagcttcagctgatattcctttttggcgtagactttctgcaattcgttcaaccttattacgactgttacaataaataattccacttttccctttttgttttgcgataaattgagaaagttgctccataggtttaaatttttcaactaaggagtaacgaatatttggacgatcaaaactaccgatataaatatggggattagataatttaagatgaataaggatatcttgtcgggttgcctgatctgctgttgcggttagtgccattattggtgcatcaggaaaacttgctttcaatcctcctaattgagtatattctgggcgaaaatcgtgtccccactgtgaaatacaatgggtttcatcaacggcaataaaactgactttgcaatgagaaataaaatgaaaaaagctggttgttaaggctttttctggagatatataaagcaactttaattttcctgacattgctttattttgaaccaactgttgttgttcaaatgtttgactggaatttaaataatcagcatttataccatttgctaataactgatctacttggtctttcattaatgaaattagaggagaaatcactaaagttaaaccggagaaacaaagagcgggaatttgatagcataaggactttccgccacctgttgccataataactaaactgtcctttttagctaaagttgcttcgataacttccagttgtcctttacggaaggactgatacccaaaaacagaatgtaaaatatcaagtgcggtagatttttccacagaatcttggctaaaatctaccgcacttttttgttgcttccattcttcaactgacattaagaaaaactcacctgttcaccatgagccaaacaagcttgttctaaacattgccaaaacaattttccatcctgagcaatccattgattatttttaaaggcaaaatgaaaacctccagccttgcttgcaagccataattctaataatggttcttgtttatttacaacaatttggctacgatcaacgaaagtaatagtaaaaaccgaaccttgagtatcacagtctacatcacaaccttgttcttctaattgttcttctatttgcaaccaaacttgttcgatattttggtgatattctgctatgttcataaagtttacctattaataaaaaagaataacaaaagattataaatatttttataagatagtgatagcacaaaggcatttttaatggtaaaaagtgcaagttttttaattaacaaggacataagcaatgaaaaaaataatttcaattttattacttagtgcaatagcttttggtgtgtcaggttgtggtgttaaaggatcattatattttccagaaacagaacaaaatcaacaaaaagttaattcaaaattaaagtaatcaatatgtaaggataacattatggatttttttctatataaagatggacacttaatggcagaaaatgtctctgtgaaaaaaattgcagagcaatttggcacacctgcttatatttattcacgagcaactctagagcgtcattggcatgcttttgataatgctttaggagatcaccctcatttaatttgttttgctgttaaatccaatcctaatatagccattttaaatattatggcaaagttgggatcaggttttgatattgtgtctcaaggtgaacttgagcgagtattatttgctggaggtgatcctaaaaaagtggttttttctggtgtggcaaaatcagaacaagaaattgcacgtgcattggaagtaggtattcgctgttttaatgtggaaagtgcggctgaattaataagaataaatcaggttgcaagaaaaatggggaaaattgcctctatttctttgcgagtaaatcctgatgttgatgctcatactcatccttatatttcgactggtctaaaagaaaataaattcggtgtaagtgttgaacaggctcgagaagtttatcgccaagcaagtcaattggaaaatataaaaattgtaggaatagattgccatattggttcacaactgacagaacttcaaccttttttagatgctacagatcgtttaattgttcttatggagcaattaaaaaaagatggaataacattagaacacgtggatttaggcggtggtttaggggtaacttatagtgatgagaaagcaccacatccaagtgaatatgctacagctttgctggaaaaattaaaaaattatcaaaatttggaaattattttggagccaggtagggcaattaccgcaaatgcaggtattttactcactagagtggaatatataaagagtaatgaaagtcgtcattttgccatcgttgatacaggaatgaatgatatgatcagaccggctttatatcaggcttacatgaatatcattgaagttgaccgcactttgtcgagagaaactaaagtatatgatgtagtcggtccaatttgtgaaacatcggattttctaggaaaacaacgctctcttgcaattgcacaaggagattttatcgtacaacgatcagccggtgcttatggtgcaagtatggcatcaacttataattctcgtccacgagctattgaaataatggttgatggagagcaagttcatttaattaaacgtcgagaggagtttgctgaattgtggcatttagaaaaattactggaaatgtaaatttttctcgtaaatttcaactaactaaaattgagtttttattctgttgttacactgtgtttttggcaacaaaaattagaatataaaataaaacaatataaaaaactgaataattaaaaataaacaatatttaattccaattaaatataattaattaataaaaaaagatatttaatctaaatttttgttgttgactggataaaatattttgttatattgctaaaccttctgtaatgaaataaaaaatataaaaggtctataaaatgaaagatacaacacaaaagcgagaaacattttccggtcgtcgtgcatttatcttagcagcgattggatctgccgttggtttaggaaatatttggcgttttccttatactacttatgaaaatgggggtggtgcatttatcattccttatttaattgcgttattaaccgcaggtattccattacttttcttagattatgctattggacatcgtcatcgtggtggtgcacctttatcttaccgtcgttttaacccgcactttgaaacatttggttggtggcaagtattggttaattttattattggtatttattatgcagttattttgggttgggctgctagctatacctatttttcaataaataacttttggggagataagcctatagagtttttcctgaatgaattcttaaaaatgggtgatattactcaaggtgttagttttgaatttgtaggaatggtgacaggtccattaattgctgtctggctgattgctttaggaatattagcactaggtgtacaaaaaggaattgcaaaatcatcaagtattttaatgcctattcttgtcataatgtttgtaattctcgttgtttcatcattatttttgcccggtgcggaaaaaggattagatgcgttattttcaccagattggtctaaattatccgatcctagtgtatggattgcggcatacggacaaatatttttctcactctcgatttgtttcggtattatgattacctacgcttcttatctcaaaaaagactccgatttaacaggtagtggattagttgtaggttttgcaaatagtagctttgaattgttagcaggcataggcgtttttgctgcacttggttttatggcagcgacagcaggacaggaagttagtgatgtagcaaaaggaggaattggtctagcattttttgctttcccaacaattattaatcaatcaccttttggtgaatttattggtgtattattcttcggttccttaacttttgcagctttaacttcatttatttctgttattgaagtaattatttccgcagtacaagataaactaagaatacgtcgagtaaaagttacttttattgttggtttaccaatgatgttttgttcagtgattttgtttggtactactacaggtttaccaatgcttgatgtgttagataaatttgtaaactattttggtattgtggctgtagcatttgtttcattagttgctattgtttccaacgaaaaattaacttcattgggtaatcacttaaatgaaacatcttcttttaaagttggttttatctggcgtttatgtattgttttaacaacaggtattctagcttttatgttatttagcgaaggtgcaaaagtattttctgaaggttatgaaggttatcctgcttggtttgtaaatatttttggatggggtatgtcgttaagtttattagttgcagcattcttactttcccgtttgaaatggaaagatgaagcattaacacacaaaaaaggagaataaaaatgagtaacagcgctattatgatgatgatcatctctttggtaattatttggggtggattagttgtatcaatattaagattacctaaagaatgataaatttcaaataaaaataccgcactttgatctgcactctaaaagatagggttaatttcccatctgattaaagtgcagattttttatgatttcatattaatagtagtaggttataaattccttaaccatcatctattctcgcatgagtgatgacagtaaaattatgctgaaatagcaattttcaaggtgagttcatgggatgggtattgattcatcattggtcatcatcaaccaagttaaacgaaaacagtatcgcaagtgcggtggagttttttgataacatactctttggttaataactgatttaaccttaataattttttgagtctagttttagttttgtgacaatgaaaaaatcccaaaacttgaaataaaaaatgattttatattgatttagtgatgaatcccctgcttttaaacaggggagggtgattttattgtaaaagtataatctcaacaggttttaatcctgctctctctagacctttattaagtttctttaaagcctgttctttttctgttttagtcaatacattgacattcttgtataaaagtgcggcagtaagattccaaaataaaatgagatttacaggaatacctgagagttttaactctatgtagcaatttgctgctccttttaatttaaaggattttatatctttaatgtgtattttagaaagaagcctttcgtgttttatcgaaagatttgggagatcttttattctttttttccgagcaagttcttgtgcaattttctttgctctagtttgagcaatagatagatagagaatttgacgaaaatgttccttattctgtgtaatttcttttggcaatagataataatttcctatatttagttgagggtttggggttaaagctaaatatgataaagcacctaggctttctaggtatttagctaattccttctctgctcgaatataaaattttccttgctggtataaaccaaacataagacctttcttaaataaaccataaccagaaaaaagatttttcacagttatagttcctatcaattcggtaagttcacttctaatattttcagtgtcttttaatgatttggtcatatataattcaacctcatttattgtgacaaaataaataaaaaccttttgattagaaaaaatctccaatcaagataagttataacacagagagtggattttattttaaataactttctaattttgttaaagtttgtgatagagatcgagaatttataaaaaagtttgctattttctttagattttttagagaaatgataaaatatgccaccgatggtttacattattattataattgtttaataactaaacaaaaagattaaaaaaagagaaaattaatcaaattttgataaaaaatataaaaaaagcttgcattgaaatataaaatgcctataatgcacggcacacaacgacacgctgttgtgagaggttaagcagtgtgtcgttattttttgttctttaacaaactatcagacaaactgtgtgggcacttgtgagactgtattaataagagattaaaagagtaagataagtgcttaaactagagaaattcatagagaaaagatggataaaatagtcagtatttattgagcgaagagattaaattgaagagtttgatcatggctcagattgaacgctggcggcaggcttaacacatgcaagtcgaacggtaacggggagggaggttactttctctgctgacgagtggcggacgggtgagtaaagcttgggaatctggcgaatggagggggatagccacgggaaactgtgggtaataccgcgtaaggtctaaggactaaaggggtgggactgagaggccacctgccatttgatgagcccaagtgggattaggtagttggtgaggtaagggctcaccaagctgacgatctctagctggtctgagaggatggccagccacactggaactgagacacggtccagactcctacgggaggcagcagtggggaatattgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcttgacatcctaagaagccgccagagatggtggtgtgcctacgggagcttagagacaggtgctgcatggccgtcgtcagctcgtgttgtgaaatgttgggttaagtcccgcaacgagcgcaacccttatcctttgttgccagcatgttagggtgggaactcaaaggagactgccggtgataaactggaggaaggtggggatgacgtcaagtcatcatggcccttacgagtagggctacacacgtgctacaatggcgtatacagagggaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaagcacgaaacttgccttaagatgagttctccctaatgaagagttagtaannnnnnnnnnnnnnnnnnnnnnnnnnnnnnnnnnnnnnnnnnnnnnnnnnnnnnntgagctaacccatactaatttcccgaggggcttaaccatacaatcttgagtgttttgcatagaggaagaagcgggacaggatagagagaggaagacttgaagtagaggcttgtttttttattgaagaagagatagagacgggatataagagagaggaatttaacttggcggcgatagtgcggtgggaccacctgacaccatgccgaactcagaagtgaaacgctgtaacgccgatggtagtgtggggattccccatgtgagagtagggcaccgccaagttttttatgatatgaccctgagtggagacactcagggttttttgttatttgggataaggcggggaagagagaagagggaagaggaaactgggagaaaaaaagtaataaggtgataacaaggtagtcataaaaagtagggtaatgaagcagcgtgaagaggtgcggtaggaaaattgtttttttttctaccgctctttttttaggtgatttatttttagcgatttgcttgacgataaatgatgatcagccactgaacgagaagttacttctagcacaacatttcaaacagaattttctctatagatttcnnnnnnnnnnnnnnnnnnnnnnnnntttatggacagatataattgctaatctacttcagaccattgtaaatttgccttattgtcttattaccttgtaggtaaaagtgcgattaaaaagtcatatgtttctttagccaatgaattactgtatgaatgttttgattgtgtttgtaaggtgttacaatataataacgctgattacacggtttttctaagcctttgaaaggggttattaattggtcattaactaaataaggtgtgattaactgttttcgccccattgcgatgccaatatggttaattgcagctgttaatgctaaattcgaacagtcgaataccatggactgtacttggtttaaattaagactgtaattgaaatatgttaaccaactctcccattcttcaaaatcggaattgtaatgccacgcttgtccgtcatgaagcaatagacagtgttctaaagatttcggattcccataaagtttatgtttctcggcatattcagggctgcaaacaggaataacgctttctggcatgagttcatagtgatgtaaattttcactatataaatcatcataatagatagctaaatctactttatacctattgaaatcaataacttcattgccagtcaaaatattcagtgtaataaacggatatttttgattaaatcctgctatagcaggaataagccaactttgagctaaggaagggcgagcataaattgtcaatgtgccactgatttcttgattacgtatttcaaaaatttctttatttatgtgaggtactaactatttttacatagataaaaaacaaaaaatttggtcggaaaaattgcggtggggctttgtgtggcaaggctttgccgttttttgtttgggggagttatgcaaaaaataagaatggttaaaaatggtaaataatgggtggtttttgcattattttttgcataannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaatacgccctagcctcaatgcccgaagttatccaaaccgaaatccgtaagaaatttgtggtcgatgtagtgaaagctcaaccgaaacaactcctctcagtgcgtgcagaagtggatttggcgaacctaactacaaaacaacgcgagatagcagatgctcgaatggcgttagtgcagtatgtgctagagcttgaacagtcaatgagtcgaattaaagcggtgacttatttatgtgatcttgcaaaaaatggcaagttgcctgcacaccttgcagagctaattgaagtggcgaatgctaagaaatcagctaagcggacactaagtgtgcgtaccttaaatggttgggtggtggattactgcaaagccaagaatgtagagcaacgtttgaaattgcttgctccacaagtgaaacaggcggttaagcctgaagagatttggtggctaacctcttttttaggtgtttaccgtcagaaaaatgggatttgtttaacggaagcctatcgtcaatttaaagttgaatgggcaagtaattatcaagaaaacccgattttactcgcagaaatgccaagtttgagccaagtgcaacgagcgatggcaaagctaccgctctatgtaaaagagtatggcagacgaacaggctcacattacaaaacgttattaagttatgtgaaacgggattggtcagcattaagagcaaatgatgtgtggattggggacggtcacgccatgaaactgaaagtggctcacccaatacatggcaagccatttacccctgaattaaccatgattattgatggtgcaagtcgaaaaattgtggggtggtcgatggcattagcggaaaacgcttttgcagtagcagatgccctacgtcacgccatatcaacacatggtgtcccagctatctactactcagataacggtggtggggaaaagaataaatttttagatgcggaagtaacggggatgttaccccgcttgggtatcaagcacgaaacagggattgcaggtaatccgcaagggcgtgggattatcgaaagattaaacaaaacagtggggttattgattgcacgccagtttgagacttactacggcacaggggcagaccctgaaaccactcgcaaggtgctttacggtgtgaactctttggctaatgcgaaaggcacagcgcttacaccggtgcaaaaaagagcgaaaggcaagctcccaagttggcaacagttactggatatggtgcaacaagtggtcgattggtacaaccaagagcatatccatagcgaaattagatgtataccagctaagaaatatcagcagatgttacacccggaagatgtggtcatgctgacggatattgaattgcgtgatatgagccgacctgagtttatccgcacgcctgagcgaggttggataagttggtgtaacaacaaatattttaataccaaattattagcagtagatgggcaagaagtagtgattggaattgatatccataacgccgaaagcatacaggtgcgaaccaaagacggcagatttgtgtgtgatgcgatttggaatggtaacacaagagaagcctttccagtggcgatgctggagcagcagcgtaaagaacgccatcaacgtcgcagtaagcttaaagagcgacaactggcagagattgatgcggagcttaatcctgttattacaattgagcataaacctgattttaacttgttggcaacagcaagtaagccgaaaaaagagccagtgccgttattttttacacaggcagaacgagaagattacgaaaaaaagttagcggtaggaggctaaaaaatgaaaaaccaacagcttaaagaatttatgcaagcccaagggttaggacaaaagcaagtagcgaatgcctttggtgtatctgtggcaacagtgagccaatacttgagcggtaaatatcaaggcaactgcgaagaattagatcgcaaagtagatgaaatgctcgaacgccagaaagctaaagtggttgaggctaaatataacgctgaatttgtaccaactttagcggcaaaacgtggaatggaagtgatgcagtttgcccacgttgaaggtgaaattaatgtgatttttggggcagcaggtttaggaaaaacgcaaatgttgaaagagtacgctcgaagaaatagctctgcggtgttaattgaggttgatccgagttgtacgccgaaagtgctactacgcaagattgcagaaacggtcggggcaacggctcgtggaattaataacgagctcttagacagtattgtaagcaaacttaaaggctcggagcggttgttaatggtggatgaagcagagttgctctctactcgctcattagagtttatccgccgcatccatgatttatcagggattggggggtgttggctggcatgcctcgcttgttggttaatctcaagggtaaaaataacgagttagcacagctctatagccgagtaggttttgcttgtgatttgggtaatgcgttaagtgaagaggatttagggttattagcagaaagtgcgttaagaacaactgaatttaacacaccattaattaaagcctgtaacggcaacgcccgccgattaagtaagttaatgcgaggtgtagtgcgatcaagtgaaatcaannnnnnnnnnnnnnnnnnnnnnnnnnnnnnnnnnnnnnnnnnnnnnnnnnnnnnnnnnnnnnnnnnnnnngtaccgtcaaatttatgcagcgtaccgtggcgaaattaatgtggcagacggtacagcagaagaattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacgaaaaaatccgaaaagtcagagaatctaaagcatggtcgcaagaacaaatgtctgaaaagctgaatatgtcattaaatggctatgccaaaattgaacgcggcgaaacgaaactatatttagataaactggagcagatagcccaagtttttgatattgatgttgttgagttgatgcagtctgatggtaagaatatctgctttcaaattgaatcaccgttaggtgcgatatatcaaggtgtgggagaatcgtctctattgattgaaattgaacgattgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcatttgttgcgtattatttgcttggtataaaacatcaccaaagtatggaatccttattaaaaaatactgaaaatggatttatggctattggtaatattttactgattataggtgccggaggggcatttaacagtattttaaaggcgagcggattaagtgatggattggctgagattttagcaaattttaatacacatcctattctattggcatggcttgttgctattgttttacatgccgcagtgggttctgcaacggtagcaatgatgggagcaacggcaatcgtgtcgccattacttgtcacttaccctgatattagccccgaaattattgtccttgctattggttctggtgcgataggatgcactattgtaacggattctctcttctggttggtcaagcaatattgcggtgcaaccttgaatgacatttttaaatattataccggtgcaactttcatcgcttccgtattagcactcgggtttacatttttattatcaacagtgatttagaggtatcattatgaaaattcaacatttaatgcaagatcctttcattcaaaaattaatgcgttttgaagaagtgatgtggtttaatcctaaaagtgcgggggtaaaaacaggattgtcttacgttgggttggatgtatccgatactcaacaggcggcggaacgtttgcagcgttttgctccttatttttgtcgtgcttttcctgaaactcaaaaaacgaaaggtattttagaatctgaactggtatctattgataagatgaaatcggcattaatcgatcattatcatatgccaatacaaggacgtttattgctcaaaaaagacagtcatttaccaatttcagggtcaattaaagcaagaggcggaatatacgaagtgttggcttacgcagaaaaattggcattagaacaccatttaattaccgaaaatgatgattatagtcaattgtgtgatgaaaagatcaaagattttttcagccgttatagtattgcagtaggatcaacggggaatttggggctttccatcggtattatgggggctgttctcggcttcaaagttagtgtgcatatgtcagccgatgcaagagaatggaaaaagcaaaagttgcgttcatacggtgtgaatgttgtggaatatacacaagattacggtgtagcggtcgctcaaggacggaaggctgctctttctgatccgaactgtttttttattgatgatgagaattcgacaacactttttttaggttattccgttgcaggtcaacgactaaaacaacaatttttggaacaaggtataaaagtagatgaaaatcatccgctctttgtttatcttccttgtggtgttggcggtggacctggcggtgttgcattcggattgaaattggcatttggcgattatgtacactgcatttttgctgaaccgactcattcaccttgtatgcttctcggtgtttatacagggttacatgataaaattgctgtacaagacttgggtattgataatatcacagctgctgatggtttagcagtagggcgtgcatcaggatttgttggtcgggcaatggaacatttgttagacggtttttatactattgaagatcaaaagttatatgatttactggggctattgcataagacagaaaatattcaacttgagccttctgctttggcaggaatgataggtccgttgcatatcaatcaccccgattatttaagaagatatcacatcacacaagaacaattggaaaatgcaacacacatagtgtgggcgactggtggtggaatggtgcctgatgttgagatgcaaaaatatttgtcactcgggcgattttaaaatattctccccaagttggtttttggggagaagaaagagtgcaagtgcggtagatttttagagagtactggaaataaataataaatttgatgcgtcactattttgtttatttttaagtgcattctgatttatttgcaaacatattgcctgttaaacaagcaaacaattaagattttgtaattttttaaaaattattgttgacttaaataagaaaaaaacgtttaatacgcaccactgacttgttgcctcgatagctcagtcggtagagcaggggattgaaaatccccgtgtcggtggttcgattccgcctcgaggcaccattctactcctccttagttcagtcggtagaacggtggactgttaatccatatgtcgctggttcaagtccagcaggaggagccaactctatgttagttatgttatagaacgatgccttattgattattgttttgttaagagggtgtcaagtagaaagtcaagaatttatctcaaaaatagattttcccaatttaaatttaattcattttaatagtatcaatcattcatattaaacttaatgtcttcaggacatggtagttccgcctttcagtgttccctatgctaatatctgcatcaacaagcacaagttatattgcttgtaatatagaaatagtgcatttgcagtgcttgcagaaccaatgttggtgaggtgtgaaaaaatgggtaatgatgaaggtatatttttttcaaagaaaattaaaaaaattaaacgttaaataatgcttaataataaaacaaaagtgcttttcttttgttaatttggtaaagtatatacatcaaaattcaaattaattagttaaaaattaagaaaaatgatatgtatacatcaaatttcactaatttaatcttaaatgtagacagctataaagcctcgcattggttgcaatatcccaaaggaacagaatatatttcctattatattgaagctcgtcgagaaagttttgatgtagtgatgttcggtttacaggcctttatcaaagaatatttgcttaaacctatttgccaacaagatgttgatgaagcagaaattgtattaaaagcacacggattgcctttttatagagatggttggcaacatctaatacataaacatcaaggttatttacccttaaaaattgaagctgtaccagaaggaacggtcttacctgttggtaacgtggtttgtcaaataaccaatacagatcctgattttttttggttagtcggctatttagaaaccgcacttttaagggcaatttggtatccttccactgttgcaagtctttcctatttttgtaaaaagcaaattagacaagctttaataaagtctgcaaatgatctatccggtttagactttcaattacatgattttggtgcacgaggtgcatcaagcctcgaaactgttgcgttggggggattagctcatttagttaatttcaaaggaacagacagtgtttctgctttaattgctgcaaaacgctggtataacattaatgaaatgcctgcattttctattcctgctgccgaacatagcacgatcacttcgtggggtaaagatcgggaaataaatgcttaccaaaatatgattgaatgctttggtggagagggaaaactttattccgtagtatcggatagttatgatctttggcatgccctggaacatatttggggcgaggaactgaaagatttagtgattgaaaaaggtggaagattgattattcgacctgacagtggcaatcctatagagattatttgcaaaaccctagaaattttagcaaataaatttggttatattcttaatcaaaaaggctacaaagttttacctgattgtcttcgcattatccaaggagacggcatcaatgctcaaagtctaccaaaaattcttgatgctgttatgcaaaaaggatttagtgccgagaatgttaatttcggcatggggggaggactgctgcaacaagtcaatcgtgataccatgagttgggcaatgaaagctagtgccatttgtattaatggacagtggcaagagatttataaggatcccattaccagtcaaagtaagcgttctaaaaaaggtgttttggctttagtcaaacagggaagtgattggttaacaattaaacaatctgagttaaatggacaaactaatcagttacaaaccgtttttttcaatggaaaactttttatcgaagaaaacttaacggaaatccgcttgcggaccacgtcctttttagtatgaccatattttatacagtgagaaaaagatgatatttgaaaaagtatcatcttttatttttcgcttaacaatgtacttactattttctagctagtggcggtacaaatgtaattcccatatcccaaggctgttcaatccacgtattttgtggaatgtcaataacataatcatcaactaaattagcccccgctggtttggcaaaaacagtaacaaaacgcgcatttgggtagagttcacgaattgctcgagcagtatttcccgtatcaactaaatcatcaactacaataaaaccttcgccaccattttttacctgtgctgcatgcaaaacatttaaattgccttgctgattatggtcataacttgaaatacaaacagtttcaatatgacgaataccaagttcacgagcaataactgcagctggaaataatccaccacgactaacggcaataatacctttccattgtgttgccggaagcaaacgttctgataatttacgtgtatgcatttggaacatgtcccaagttacaacatatttttcgctcataattcaccctaaagtcagttgatagcggagttccgcctgagaaataaaatggcgttagaataacctgaaatctatttttatgctattattttccttatttttcgctaataaaggataaaaaaatatgtcagatcttcaatctctgcaacctaaactactttggcaatggtttgatcaaatttgtgctattccacatccttcttacaaagaagagcagttagcacaattcattattaattgggcaaaaacaaaaggtttttttgcggaacgtgatgaagtcggtaatgtattaattcgtaaaccggcaacagtaggaatggaaaatcgtaaacctgtagtactacaagcacacttagatatggttccacaagctaatgaagggacaaatcataattttgatcaggatcctattttgccatatatcgatggtgattgggttaaggctaaaggcacaacgttaggtgctgataacggtatcggtatggcatctgcacttgctgtcttagaaagtaatgatattgcacatccggagttggaagtattgttaaccatgactgaagaaagggggatggagggggcgattgggctacgtccaaattggcttcgttctgagatcttaattaataccgatactgaagaaaatggagaaatttatataggttgtgccggcggtgaaaatgcagatcttgaattacctattgagtatcaagtcaataatttcgaacattgttatcaagttgtgttaaaagggttacgaggcgggcattctggtgtggatattcataccggacgagctaatgcaatcaaagtgttgcttcgttttttagcagaacttcaacaaaaccaaccgcactttgacttcactttagcaaatatccgtggcggttctattcgcaatgctattccaagagaaagtgttgccactttggtctttaatggtgatattaccgtattacaaagtgcggtacaaaaatttgcagatgtaatcaaagccgaattggcactaactgagccaaacttgatatttacacttgaaaaagttgaaaaacctcaacaagtattttccagtcaatgcacgaaaaatattatccattgtttgaatgttttgccaaatggcgtagtacgtaacagtgatgtcattgaaaatgtggtagaaacatcattaagcattggcgtgttaaaaactgaagataattttgttagaagtaccatgttagtgcggtcattaattgaaagcggcaaatcctatgttgcttctttattaaaatctttagcctcattagcacaaggtaatatcaatttatcaggcgattatccgggttgggaaccacaaagtcatagtgatattttggacttaactaagacaatttatgcacaagttttaggtacagatcctgaaatcaaggtaattcatgcgggacttgagtgtgggttattgaaaaaaatctatccaacgatcgatatggtatctatcggaccaacaattagaaatgcacattctccggatgaaaaagtacatattccggctgtggaaatttattggaaagtattaaccggtatacttgctcatattccatcacgttaaaaattggtatacaagacaagtataaagagcggtgtaaatttgcaaagaattgagcaagcccattagataactttctcattcttaaaactaaaaatccttgtagaaaattgttttttacaaggatttttgtatcgaacaacaatctgtttaattcaacattttctttaactgatataaacactcaagtgcttgcttcggacttaactcattaggatcaagcgtttttagcgtttcaatcaccgcacttgtattctcctcctcttccattaaagttaattccccttgaacttgtgtcaaaacggactgtgattggtaactgttttgctgagaaagtgtttcaagctgttttaatttctgttttgccgatttaattacattttgtgggacaccggctaaagcagcaacagccaaaccatagcttttacttgccgcaccttcctgtaccgagtgcataaaggcaatactgtcgttatgctcaaaagcatcaagatgaacattatggataccttcgattttttccggtaatcccgtcagctcaaaataatgcgtggcaaataacgttaaactgcggattttttgagccaattgttcagcacaagcccaagcaagagaaagtccatcataggttgaagttcctcgcccaatttcatcaataagcactaaactttgctctgtggcttggtgcaaaatatttgccatttcagtcatttcgaccataaacgttgaacgtccggaggcaagatcgtcagaggcaccaatacgtgtaaaaattcgatcaataggtccgattaccgcactttctgcaggtacaaaactaccaatatatgccattaaagtaatcaatgctgtttgtcgcatataagtacttttaccccccatattcggtcctgtaataatcaacaaatgacgcttttgattaagttctacagggttagcaataaaaggttcttttaacacttgctccacaaccggatgacgcccttgcattatttgcaaaccgacttgtgtactaaattgcggttgaacataatttaaggtttctgcccgttccgctaaattggttaaaacatcaagttctgccaaagttaaactggctagttgtaaatcacctaagtgcggtaataattgatcgaaaatttcatcataaagttgtttttctaacgcaagtgacgctccttttgcttttagaactttttcttcataagtttttagctcaggaataatataacgttctacatttttcaatgtttggcgacgtacataatgaagcggtgctttatgtgcttgcccttgactgatttgaatataataaccatgcaccgcattaaaaccgatttttaatgtatcaataccagtatttgcacgctcacgttgctccaaatcctttaagtagcgtgttgctccttcagacaaactccgccattcatcaagctcctcgttgtaaccttcagcaatgacacctccatcacgaataagtaaggggggattatcaataattgctcgctgcaaaagtgctaattgcacagaaaaatcagcaatttgttgtgaaaatgcaacaaagtgcggtatttttgttaattggtgttgaataaaaggtatttgttccaacgctgttcgtagccgagttaaatctcgaggtcgagcggaacgcagggcaacccgagcaagaatacgctccatatcgccaacttgacgtaaaagaggttgtaattcttcaactaaattttgctgcaacagcatttgaatatgttgttgacgatactgcaatttttcaatattgcgaataggctggtgaatccaacgtttaagtaagcgacttcccatcggggtaacacatttatctaaaattgcagcaagtgtattttcagttccgccagcaagattttgggttagttctaaatttctacgtgttgacgcatcaatttgtacagtatcgctattttgtaacaagctaatactttgaatatgaggaagtgcggtacgttgcgtttcttttgcatattgcaacaaacaacccgcagcacataatcctaaaaccgctttttctacaccaaaaccacgcaaatcttttgtaccgaattggcgattaagtaattgaattgccgtacttaattcaaactcccaaagaggacgacgacgtaatcctttgaattgttcaattaaatgtttatcctctaacgcttccgaatatagtaattcaaccggttgaatacgttgtaactccgcttgtaaactggcggcatcttgtagttcgctaatttgaaaacaccctgaagtcatatctaaaacagctaagccaaattgtgttttttcttgataaatcgtagcgataagattgtcttgcttttccggtaacaatgcttcatcactcactgttcccggtgtaacaatacgtacaacttggcgttcaaccggacctttagctataacaggctcaccaacttgctcacaaattgctacactttccccaagttgtaccaattttgctagatatccttctattgcatgataaggtacgccagccattggaaccggttgtccagctgattgccctcttttagttagggaaatatctaataattcagcagctttttttgcatcatcataaaaaagctcataaaaatcacccatgcgataaaacaacaaaacgtccggattttccgcttttatttttaaatattgtttcatcattggcgtgtgattttcgaatgtgtgcatggctttcattgtgttaataagtaaaaagaatgagtggaattataacaaaagtgcggtctgttttgctggtgttttttgtatctgctttcaagtcaaaagaataaaaatatgtctaaatgatcaagcggttgctcctgccttttatatttttatctcgtttccactaaataaagggtcaatttccggcattacgccacgccataaataaaatgcgtgagcagcttgcccaaccagcataccgaagccatcgctaattttggttaccccctgttttttacacaatgcaataaaaggcgtgtcgctttctttgctgtattgcatatcataaacggcagaggcaagttgtaaaatctgaggattaatatcaatagttttaccttgtaatcctgttgatgtagcattgatgattaaatcaaatgtttgtatcggaatatgtttcagatccaacgcctcaatagtgccaaattgattgaatttatgtgctaagtcttcagctctactaaaagtgcggttggtaattaagatattttgttgagcttgtaataaaggcaataaaactccttttgttgcaccgcctgcacctaaaatcaatattctttggtttggtttgagccaatttaaacgttgtaaatcgctcactaaaccggcaccatccgtattatcagcaaataatgttccatcagctaatttttttaaggtgttacaagactccgcacttaaacaacgcttgctatgttgttgtgccaatttaaatgctcgctctttgaaaggagcggtaatattgcagcctttagcaccttgtgcaaaaaaatcgctcaactgttgttcaaatttttcttcatcacccaatatcgctacataatctaagttttgtcgagtctgcttcgcaaaatatcgatgaagttgaggagatctactttgagcaatgggattcccccaaactgcgtatttatccattttttatccttgtctaactaattgattagtaaataaatcacgaatttcagatggttttgcggctgagccaaccgacatatccaatacaggaaaatccgccccgaattgtaatctgacttcatcgctggttttgcaaggtgcaatcccacttaaattggcactggtagaagttaaagcaaaacctgtttgttcgcaaagtattttgatggcgggatgttggcttactcgaatagctatactattaaaattgccacataagaatttagcaatatctttttttgccggcacaatccatgtaatggggcgaggataagtttgttgtagtttttgccaatgttgagaattgatctgttccttatcaataaaagaaaaaaaataatctaatttgggtgcaactaaaattaaacctttttctcttgggcgttgctttaaaattaataatttttctaccgcactttgactaaaagggttacaacctaaaccgaaaacagcctctgtcggataggcgacgacttcattttgtttcaatttttcaataatttgtgtgatattcatattgttgttttgaaaatatgttgacaatttttattgatacacaaccaagtgcggtgattttcgtcttcttttttcaagattgcaccttgcatttggcaatgggggcaagggattaaatgaggtttttgtgctaaggtaaatttgcatttcgggtactgattacaagcataaaaattttttccttgccgtccatgtcgagcaacaatttcaccatgttgacattccggacaaacaatctgttgttctgtcgtttcttgttcttcatgcacgacaaaacgacattccggataaccgctacaaccgataaacatgccgtaactaccctgttttagttgtaaaaaacgaccgcacttcggacaattttgagcaagatttttaagtattttactttcattattagggtgtaaaggcttgatataatcgcaagatggatagttagaacaacccaaaaacaaccctttttttccttgtttcatctgcaaaacagcttcacattgaggacaatgttcttgatgtttggtatgttggaaaaggctttttgacatattcttttttcaatcctcgtgagaaaaaacaacaataaacgatcctatcaataatatcaacttacaatcctaatttgaaagccattctagcacagtgtagaatgtgcaacattgtatttaggataagagttttatgaatttacaagatcattttttgattgccatgcctcatttagaggacgagaattttcagcgttccgttgtgtatatttgtgaaaataatgaacaaggctcaatgggattagtgttaactcaagcaacagatttaagcattgctgaattatgtgcaaaaatgaattttatgatggcggatgagcgtgaatattccgataaattagttttattaggtgggcctgtaaatttagagcatggttttattttgcataagaaaacagcccaagaatttcagcatagctataaagttacagatcaaatttatcttacaacttcggcggatataattaatacttttggtaccgcacaatcaccggaaaaatatttggttactctggggtgtgcaagatgggagccgaatcaactggaaaatgaaatagccaataatgattggttggttgtgcctgctgatgaaaatattttatttgatgtgaacagttcggaacgttggtttgccgctaatcaattattaggtattgagcatgtaaatttttcgtatcaacaacaaatggaacatagttaatgtcaattacagttttagcctttgattttggcacaaaaagtatcggttgtgctgtagggcaaagtataacaggtacggcacaagcactcccggcatttaaagcacaagacggtatacctgactggttaaaaattgaaaaatgtttgaaagactggcaacctaatattgttgttgtcgggttacctttaaatatggatggtagcgagcaagatctcactcatctagcgagaaaatttgctaatcgtttgaacggtcgatttggtgtgaaagttaaattacaagatgaacgcctaacaaccaaacaagcccgtgatgaaatattccaacgaggcggttaccgagccttaaagaaagaaaaagtagatagtatttctgcctgtttgattttagaaagttggtttgaaaatggtgcttgtggggaataattacactaaaattaactcaatttccatttcttttatcgattcttgggcatttagtaacagcttgtcatcgcaaataatgctattgaatacatttaattcacaaatagaaaatgtagctgtttttccatatttagaagaatcagataccaaaattttgttgtaactggattgcaatattgcttttttaacaggcagttttttctcatccggtgtagttaagcctcttaaattccaagatgatgtggaaataaatgccagatcaattgaaagctgtttcaataactgtgtagccaattcaccaacagaggagaaattagatttattaattgatcctcctgtatgaattaattcacattgtccatgtttcatcaagaaattagctatcacaaaatcatttgtaatcaccaacagatcttctcgttgagcaatattatgtgcgatttctaatgttgttgttccagcatctaagtagatagttgtatttaccggtattagctcagccgctcgactaccaattttttctttttgtagcgtggaaagcaaagatttgtcattgtgtgtcggttcaataaataaatgttctaataatttcacaccgccggaaactgaaacaacaataccttcttgctctaatttttgaatatctcgacgaacagtcatgtgagatacacctaataattttactaattcattgatactaataatctcttgcttactaatcagcttaagaagttttttttgtctttctgccggtatcattttttactcctgattttttacataattatatcactttttccatttaggctaatatctataaaattaacattatttaacaaataatgttaaatagtgtgatcatgatctcattttttttgtaaaaaaaagtgcaaaatacaccatcaaataactttaaaggagtgatcagtatgaaccaaaaactattttctgtcgctgttattggtttaggtgcaatggggatgggagctgcaaaatcatgcattcaagcaggattagatacctatggcgttgatttaaatttacaagccttagagattttaaaaacagctggagcaaaacaagtgagtacaagtgcgataggttttgcaaaagatttagatgctgttttgctattagtcgtcaatgcaaatcaagtaaataatattttatttggggaacaaggattggcacagcatttaaaacctaaaactgcggtaatgatttcatccactatttctgcacaagatgccaaagaaatttcacaaaaattaacaaaacttgatttgataatgttagatgcacctgtatcaggtggagctgcaaaagccgctcaaggtgaaatgacggtaatggcatccggatctacagaagcttttgagaaattaaaaccggttttagacgcagtttcaggcaaagtgtataacatcggagaagagattggtttgggtgcaaccgtaaaaattattcatcaattactggcgggagtgcatattgctgcaggggcggaagcgatggcattagccgcaaaagcaggtattccacttgatttgatgtacgatgtagtaactaatgcagcgggcaattcatggatgtttgaaaaccgaatgaaacatgtggtagatggcgactatacgcctctctccatggtcgatatttttgtaaaagatctcggtttagtgaatgacacggcaaaatctttacattttccacttcatttagctagcacggcttattcaatgtttactgaggctagtaatgcaggctacggtaaagaagacgatagtgcggtaatcaaaattttcagtggtcttgatctaccgaaaaaaggaggacactaatatgttaggtgtcatagcagatgattttaccggtgcaagcgatattgcgagttttttagtcgaaaatggcttaaaaacagtgcagatgaacggtataccaaaaatcgcacttaacagcaaagttgatgcaattgtaattagcttgaaatcacgttccaatcctgttgaggaagctatccaacaatcgttacaagccttagattggctaaaacaaaatggctgtacccaattctatttcaaatattgctcaactttcgatagtactgaaaaaggcaatatcggaccggtaacggatgcgttaatggctgcattagaaactgattttactgtcattacccccgcacttcctgttaatgggagaactatctttaatggttatttgtttgtaggtgatgtattgctgaatgaatccggtatgcgtaatcatccgattacaccgatgaaagaggctaatttagttcgcttaatggacgcacagtctcaaggtaaaactgggttattgacttatgcagatgttattcaaggtgcagagcgtgtgaaagcacgttttacagaattaaaacaacagggctataaatatgcagtagtggatgcggtagataattcacagcttgcggtacttgctgaagccgtggcggattttaaattggttaccggcggctcaggtttgggggcttacatagcagcgtatcgctcaggcggtcagaaaggaacgaatgcttttgtaccgaataaaggcaaaacggttgtactttcaggatcttgttctgtgatgacaaacagccaagtcaatgcgtataaagcccaagcaccaagttatttcttgcaagccgagcaagccattaacaatccaaattatgtggaagaactttatgcgtgggttgttgaaaatctaaatggcaactttgcaccgatggtttatgccactgtaccgcctgaaaaattgaaagaaatccaacaccagtttggtggggataaagcaagccatgcgattgaaactacatttgcaaaacttgcaaaaaaattgaaagttgcaggggtaactaacttcatcactgcaggcggtgaaacatcgagcattgtagtccagcagcttgctttctctgggtttcacatcggcaagcaaattgcacccggtgtgccatggctacaagcagtcgaagagccgatttttcttgccttaaaatctggtaacttcggtaaagagaatttctttagttttgcacaaggaatgtgtgtatgacagaacttgaacaaaaacaacaaatggttgctttagctcgttcattatttgagcggggatatacagtaggtggtgcaggcaatctatccgtgcgtttagataaaaaccgtattttagttacgccaacaggttcttcactcggacgtttagaagcagatcgactttctgtgttagatatgcaaggaaatgtgctttctggtgataaaccgtccaaagaatctgttttccacttagcgatgtatcagaaaaatccgagttgccaagcgattgtacatctacattctacttatttaaccgcactttcttgtttggaagatttagatacggaaaatgcaatacgagccttcaccccttactacgtgatgcgtatcggcaaattacctgtaattccttactatcgcccgggcaacttcaatattgccaaagaattaggcgagagagctttagatggcaaggcttttctgcttgcgaatcacggagtggtagttacaggagaaagcctaatagatgccgtagataatactgaagaattggaagaaaccgccaaactctattttattttacaaggtcaaaaagtgcggtatttaaccgatgatgaagtcaatgacctgaaacacagaggaaaataaacatgcccaaatttgctgcaaatttaaccatgatgtttaacgaagtcccttttttagaccgttttgaagcagctgctacagccggttttaaatatgtggaatacctttggccctatgattatccagcagatatgctaaaggaaaaattagataagtatggtttacaacaagttctatttaatacttcagcaggcaatgtagacgccggcgaatggggtgtctctgcgattccggggcgagaagcggatagccaccgtcatattgatcttgcattagagtatgctcttgccttaggttgtccacacgttcatgtgatggcggcagttgtaccgcaaggcgaagatcgagaagcctataaacagactttcatcaaaaatgtgcaatatgcggcagataaatttaaaccgcacggtattaaagtcttgttagaagcacttagcccggaagtcaaacctaactacctgctgaaaagtcaattcgacacgctagaaattgttgaatccgtcaaccgagataacgtctttgtacagttggattatttccacgcacaaaatgtagatggcaacttgtctcgcttaaccgacaaactcaacggcaaatttgctcatatccaaattgcctccgtgccgaatcgccatgagcctgatgaaggtgaaataaattaccaatatctctttgataaattggatcaaattggctatcaaggttttattggctgtgaatataaaccacgctctgacaccttagcaggtttagattggtttaaaccttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtaaaaagccctatttttcatgggtagggctttttacactctgcaaacccaaaattgcattaaaaacaagcagtttttgtttaaagtgcaacctattttaaggaggatacaatgaaaattgttattacaggaggacaaggttttttaggacagcgtcttgcaaagactttgttatccaattcaactttatcaatcaatgaattagtgttgattgatgtcattaaacccattgcaccaaacaatgatccacgtgtgcgttgtttggaaatggatttgagaaatcctgaaggtttagatgaaattattaccgaaaaaacaaccgctctttttcacttggctgcaattgtgagtagtcatgcagagcaagatccagacttaggctatgaaatcaatttcttagcaactcgcaatttattagaagtttgtcgaaaaaataatcctaaagtgcggtttattttttcaagttctttagcggtgtatggtggtaatttacctgaaattattcaagatcacaccgcagttacaccacaatctacttatggttctcaaaaagcaatgtgtgagttattgatcaatgattattcacgcaaaggctttgttgacggcattgtagttcgattaccaaccatttgtattcgtccaggaaaaccgaataaagcagcctcttcttttgtaagtagcattattcgtgagcctttacagggtgaagaagccatttgtccggtttcgtcagatttacgcctatggctttccagtccaaataccgtaattaataattttattcatgcgttcactttgccatcgctaccacagcgtagttggcacattattaacttaccgggctttacggttagcgtaaaacaaatgctatctgatttagcttcaataaaaggtgaaaacatcttagaaaaagtgcgatttgaatttgatgaaaatatcaacaacatcgtcgcaagttggccggcagagattgataataaaactgctcttaaacatggctttaacgtggatgttgatttcaaggaagttattcagcaatttattaaaaacgatatgtaacttaggagcaacagtatgtttgacttaccaattccaatcattggactattgattgcggtatttgtcttagtctatttagtgttaaaaacacgtgttcatgcatttattgctatgctgattgcttctgcgattgccggccttgttggtgggatgtccgtcaatgaaactctcggtgccattagtaaggggtttggtggaaccttaggcggtattggtattgttatcggtttaggggttatgatgggaagcgtgcttgaggtttcaggggcggcagaaaaaatggcttacagcttcatcaaactgctcggcaagaaaaaagaagagtgggctttggcaattactggttatattgtaagcattcccattttcgttgactcagctttcgttattctttatccagtggcgaaagcattggcaaaaaacggaaaacgttctcttttaaccttaggcgttgcacttgctggtggcttagtggtaactcaccatactgttccaccaacacccggtcctttaggtgtggcaggattatttgctgttgatattggtgctatgttgttagtggggatggctctcgctatattgccggttattggtattgttctttacgcaaaatggctagataaaaaatatccggaatttaaccaacaagttttcactcaagaagaattgaaacaaaaatacgatgactatattgaaagtcgtgagaaaaagaatttaccaagcttagggttatccttactgccaattgttttgccaatcgttctgatctttatcaaagcaatgtttgatttaactgcaaaaggtcatgcggaactggctcaaatgggagtttatcaattctttgcttttgttggtcatccaatgattgcattagcaatcagcgtattagttgctgtttataccttattaccaaaagcagaccgtgattcgaccgcacttcatctcgaagaaggagtcaaaactgcgggaattattttattggtaaccggagccggtggtgcattaggtgctgtgctacgtgacagcggtgcaggtaaacaactagcggaacaaattgcttcattgccaatttcaccaattcttattccgtttattgtttcaacccttgttcgctttattcaaggttccggtacagttgcaatggtaacggcagcctcaatatccgcccctattttggctcaaattccaggtgtgaatatgttgttagcagcacaagcagccacaatgggttcattattcttcggttactttaacgatagcttattctgggttgtgaaccgtatgatgggcatcaatgatgtgaagaaacaaatgatagtttggtctgtgccaaccacgattgcgtgggggattgggggtatcagtgtgattctctgtaaccttgtctggggtaacgatggctcattatttgatcttttgttccctattgctgtaatggcaattattgcattctacatcaagttccaaaatagaactttgaataaataatcaacgcgcaaatagactatgaatgttattcgtagtctattttttaatctaaatgaggagtgaatatgaaaaaatattttattttggctagtggtttgctgttgtccactttggcctgtgcaatacctgatgaaattaaacctaattccaatgtgaatataactttgctcgcagaagtaaccgcacaagggtggagtaaggattgcctatcatcatttccattactctattaaattcttcatagaatctatgatttagagtgataatctgctgagcgtaaaggcttagtgtttcttgtgcactgtctaaatgattcattttcttccctcacaagcgattaaagctcactaattttttgaaatttacgcaatgataataaccccatatttgagcaccaaataaaaaatcactcaaatataattgacaaccattattattttattttaatgtgaatatgctgtagatcgttatagcaaaattatcaattaacaaaaaacaataggaggcaactatgcgtggacgtcgactaaactaattctataaaaaattatagaggtgatctaattagatcgcttctatttatcctctatataaataaggaagcatctatgaaatatatcacttctaaacatgtattttttgactatctaaatgaaaatgaatttgttattgggataggtagtaaccaagaaattacaaacaacaaagattattttaataattgtctaaatttatgttatttttgtataaatcctaagagcatttctgaaatattatcttttataaaagataataatatagacattctatatttcgataaaatgaagaaaatgaagtttattacaaaagaaataatagacttcaatgatagatacagtagaaatcatttatactataatgcattaggatataaaatatatgatatacaaaataaaatatctaaatctcatattcttattgttggtgcaggaggcataggaaatatttgctcctatttattaggaacaataggaattaagaagttaagtatcattgatgatgatatagttgaggaatctaatctaaacagacagttcttatttcgagagaaagacataaacaaaaataaagtagaaacaataaaaagagagttattatctattcggaaagatattattattgatattttcccagagaaattaaataaatctattttagataaaatatcacaaatagatttagttatttgttcagcagatgatgagtattgtatagatatgattaatgaattttgctgttttaataaaattcctctaattaacgtaggttacctcaatgatatttctgttatcggaccattctacattccaaagttagaatatagctgttgtttatgttgtgataagtctatatatttagaaaatgatgttatagatgaaaaagtgaagaaaattaaatcagttacgaaagcaccatctactatcattaataatttctttgctggtgctatgcttggttcagaacttattaaattctttgcacgcgattacaaatcaatgcaaagtattaattctgtaataggaattcacaataagaattttaagtatgaagaaattaagttagccaaaaattataattgcaaatattgtggagtaaataatgagacactatgaaaaaatcatcactagctgtgtatctacctctgcaacccgtatgctgattggggcggtctccacagtttatatgcttgtatcaggcattaatttatatgaagttgggttaattaaaagcactcaggctattttgatttttgtgctgggatttgcagtcggcattctgtcagaccgaatagaacgaaaatggctacatattaccgccttaattttttcgactttttggctctattttttctaccttgcgggtttatacaagagctttaacctctttttattagcagaaatcctcaatgcgatttctctctgtatttatcaaaacaataccaatgcttatttagtagatcagttttatcacgagcaaccgaaaggtgaactcagtcttgccttaggaaaattaggaaaatgggagttttccttgatggcattttctgctttattaggagggggcttatactctacgctatcagagaacctctttttattaacaacgattattatgtcgatcgttacagtcgcttcctttattttgcttcccaaggtgagcaggagagctacacataagactctaccatttattcaaaagcaggactttttaattcttatacgtaaattcagtcgctacaaacaagctattttcttatttgtggtgctaagcctctattttcaaattatcattcaatattggcaagcagttgtttacgccataaacaaatcagagcagaatggacttattctaggagggatgctatttttgatgtttatggtacaatcttgggcaggaaaagcaattgaggtaaaatatccattcagtcgcttaacccttgccttaagctttctcagtagtatggtgttatccttttttgcagaacggtggcaatcggtcttcttttacacaatcgccatttgcttagcattatttgtggtacgatatacagtgattcaaaccgacacagagctacatagacatttactctctcgctttagagcaaaatacgatatgctactcaactcattagtgagaattttaaccgctgtagtcttactgatcattggttatataagcaatctttatggtatacaagccattcaaatcattggattaataattgctatcatatttaccctttttgcattaataacttcacaaaatgtaaaatagaaaaaacttaacccattgtttaagatgagaaaatggatgtttttatagtctattttttaatctaaatgaggagtgaatatgaaaaaatattctagcaccagtattgcattattacaacaataagtatattcaagtgaaagtgtgtcctatgaaatacagaacgcagttcttgaattaaattaggttaacttaaaaacggtataaacctatgtaatcagttatcatattaaagatattagctcgttgggtttattccaaaccaatgagctttttcacagtaaatttctttatgtagttttagattcctactataacggggtttacattgaatagatatccatcaaaattagtgtcctctacatcggataattcaagcaatttagttttaacattttctagatgttgccacattgctttacgtgccaaagcaggatttttgcgctgaatcgcatttaaaatcgtttcatgatctttaatccataagtgatggagatcattatgtatgatacgcgaatgaagctgtgtccacatagcattattaaaacgatatttccaaagttgctcttgagtttgaataaggacatcgtttccagtaatttcggcaagagcaagatggaattctttgtcagcactgcagtcatcaatattttgagcaaataattccttttctttatcaagaatttgcctaagtcgtaaaatatcttgtttggtaacctgttgtgcagcaaattcagcaatactgctttctaacaattgtcgtgcttgaagtagttcaaatgggcctacatctcttagcttattatctgcttcttcttgaagaagatctgggatttttatgacgtatattccggatccttttcttacttcaataatcttttccacttccaacattactatcgcttcccttacgatagttctacttacttcaaatctttcagaaatatttctctcggtaggtagcttatcgcctattttgtattttccttgagaaatttcctctttaagtatttttcctatttttgtgtaagttctagaattattttgcataaatcctcgcaatattggcacgccaaaataaatttatgtgatcagtatcacaattatagaaaattggaataccaaaaaatatactttgatgttactgtctgttcataaaatatcattgacgacattaaatgtcgattaactttgttaaagagggaaacattatgagcaaatacgtaagatcagtttgtctcgtggaacctaagaaggttgatataaagaccgtgttgtatcctaaaaaaggtgagtgtgatgttctgatcaaagtagagagtataggaatctgcggatctgatattggtgcatttagaggtacaaatccgctggtaacttaccctagaattttaggacatgaaattgttggtacagtcattgaatccggtgttggtatgccaaaaaatattaatataggtgatcgtgtaattctcgaaccttacatttattgtggacattgctatccttgttcaatcagtagaacaaattgctgtgaggcactaaaagttttgggggtacatattgatggagcaatgcaagaaattgttagacatccagctcatatgcttattaaagcacctgatataccgatacatgaactggctttagcagaacctttaactatttcattacatgcaattcgtagaaccaaagtaaaagccggagaacacgttgctatcatcggtgcaggtgcgattggactgatggctgcattagttgccaaagcttatggtgcgacaccaattttaattgacattttagacaagcgattagattacgcaaaatctattggcattccaaatataattaacccagcaaaagaaaatgatcttgaagctattaaatccattactaacggaagaatggctgaggttgttattgaagcgtcaggagcaaatattgctgtacaaaatacgcttaaatatacttcttttgcaggacgtattgctttaactggatggccgaaaaacgaaacgccactaccaactaatttaattaccttcaaagaacttaacatttatggagcaagaacaagcaagggggaatttgaagaagcattaaaacttttagaatccagaaagattgaaccgaagaatattattagtaaggtaattacatttgatgaaattcctcactacatcgaagagctttcagaaaatcctgatgattatttaaaaatcattgctgtattttaagtcttaactaacctatgaggtaataattatgaaactcaaaaaattaactaaagtattagttgttgcaggcttagtatttagtagttcggcatttgctaaaactgtaattaaaatcggacattttaattccgatatgcacccgtcaaatattgtattaaacgaagttttcaagaaaaccgttgaagaaaaaacgcaaggtcgctatgaaattcgtattttcccaaataatcaattgggcggcgaagatcaaatcgtaaatggcttacgcaatggtacgattgaaggtggaattaccggcttattgttacaaaatgtggatcctatttttggtgtgtgggaaatgccgtatttatttaaagacaatgttgaagcgaaaaaggtattggaatctccgattgcaaaagaaattggcgataaaatggaacaatacggtattaaattattggcttacggcatgaacggttttcgtgtgatttcgtccaataaaaaattggaaaaattcgatgatttcaaaggattacgtttaagagtgccattgaattccttgtttgtggattgggcaaaagcaatgaatattaacccgcaaagcatgccattaagtgaagtctttactgcattagagcaaaaagtgattgatggccaagaaaatccatatatgttgctcaaagattccggtttgtatgaagtacaaaaatacattatccaaactaaccatattttctcaccgggattattgcaattaagcttgaaaacttggaataaaatgtcaaaagaagatcaagaaattttcttagaagcggctaaattatatcaagagaaagaatgggaattagcgatgaagatggaacaagatgttaaagacttcttccataaaaacggtaaagaagtaattattccgtccgagcagtttaaagcagatatgttgaaagcctctgaaacactttatcaaaatttttatcaaaaatatgattgggcaaaaggcgtgattgaaaaaattcaagccgctaaataattgaaatcataggctgtttgttagcaaacagcctttttcctatcgctttttaggagataaaacaatgaaattttctaccacacttgaccgcactttaaagatgttggcagtgattgcattagtgacaatgattttattggtcttttttaatgccatgctacgttattttttcgattcaggtattgcttggtcggaagaatttgctcgaatttgtttcgtctatatgatttttttaggcattatcttagttgccaaagaaagagggcatttgactgttgatattgtgatttcttatttacctgcatacgtacagatgtatgccttattttttgctgatatattagtgttgcttgccttatcttttattacttatggtgcatatcaattaatgttgctgacttatacacaaaaaatgcccgcaacggaaatttctaccgcatttttatatttagcagctgtgatttcttccttatcttattttctcgtggtttttaccaatttatggaaacatttaaaactggcatttagaggagggaaagcatgatgttaggattatttttaggtagcttattcctatttttatttcttggtgtgccagtagcgttatcaatgttactgagtgccagttttatgttatggcatatggatatgtttgatactcaattaattgctgaaaactttgtaatgggtactaataactttcccttaatggcaattccattttttatgctgactggtgaaattatgaaatacggcggtatttctgagcggattatcaattttgctatgagtatggtaggacatattaaaggaggattaggttatgtagtgattatttcaggtttaatctttgctgggttatctggttctgctgtagcagacaccgcagcgttaggtgcaattttaattccaatgatggtagctaaaaaatatgatgttgctcgttctacaggtttagtctgtgcggcaggaattatttcggtggtcattcctccaagtattccaatgattgtatatggaattaccgcaggtgcatccattaccaaattatttatgggtggcacggttcctggattattaatggttaccggattgtggttaatgtggaaatttttatatcgtaatcacgaagaaaatataaaaccgaaacaatctggtgcagaacgctggcaagcttttaaaaaagcttttttcccattattgttaccggtcattatcattgttgggttgcgtggcggtatttttactccaacagaagcaggtgtagttgcggcgatttatgcgggattggttagtcttggctatcgcagtttaaataaagaaaatttaatcgaggtctttttaaatacgattaaaactacttcaatggtgatgtttgttgcggctgcggcaatgatttctgcatttgcaattactgttgctcaaattccaacggagttggtgcaatttatcaaaggattaactgacaattcaacggtattaatgttggttattatgattttcttattactcgttggttgtgtaatggatttaattcctgcagtattaatttttgtacccgtattattgccagtattgagagcttacaatatcgatattgcttattttggtattatgatggtgattaacttatcgattggcttaatcacacctccagtgggaacggtactttatgttggttcgggaattgctaaacttggcataagtaaaattagtaagggaatttcgccgtttttgttagtttatgttgctattttaatgttgatggtgttctttcctgatgttgtgattgtaccaatgaattggttatcttagtggtgcttattatatccattgttataaagacaaagttgtcgtaatgacagaagctggcaatatgaataaagcgatattttgtaataaaaataacgtataaatcgcaatttttacaaattgatttgacagaaaagatattcgggtgtaaaacattttttacatttcattaacattttggaacgttttatgctcaccattcatcatacgagtgaacaatcacttctctgtgaaattgctcctcctgctgaacttgccaagcaacagcgaatttggcaaattgcagagcaggctaggcaacttgccaatgtgcaagaagtagtggttggtatgaataattttactgtctattacgatttatttgcagatagtcaaccattaattgaaagcctgcaatcactgtgggaaaattatcaaccacaatcagttaaaacaccacgctgtattgagattccagtgcattatggtggcgagtttggtgaagatttatttgatgtagcacaatttcaccaaactacgccaaaagaaattattcgccgtcataccgaacctgtttacactgtgtttatgatcggttttcaagctggatttccttatctaaacgggttacctgaaaatctttatacaccaagacgtgatatacctcgtactaaggtgcctgcaggctctgtcggcattggcggtagtcaaacaggaatttatccttttacctcaccgggtggctggcagttgctcgggcgtactgatttagcactatttgatattcaacaatctccaccaacactattaagtgcgggtgataatgtccgttttgttgcagagagtattcaactatgatctacattaaacaagtgcaaggttttgctcatattcaagatttaggtcgttatggctttcgttctctcggtattggacacagcggtgcaatggattctttggctttacaagcaggcaatttattactaaaaaatgcaaataacgctccagcaatagaaattacgcttggtggaatgagtttgacatttgattgcgatactccattttgttttactggtgcattagtagaggctgaactggatggcgtgcctgtattttcctactttcgttatactgccaaagtgcgtcaaactttaacgcttaaacgtattataaaaggtaattatacttatctttgcgttgctggcggttttcttgtaccacaggtgcaaggctcagccagtactgatctcagggctcaatttggtggttatcagggacgaatgttaaaagctggagactgtattcccaccgctttgcgtgatatacagttatcatttctcagtattgaaccaattgattttactcataagattgggacgacactttcgtctgaatatgaggcgtttactactgaaagtcgtgagcgttttttccaacagagatgggttctgcaaaataacagcagtagaatgggctaccgttttgcagaaaattcgttaaaactgaccgcacctcttgaaatgctttcctatgcggcgcctgctggcacagtgcaagtaccacctgatgggcaacctattgtactaatggcagatgcacaaactacaggaggttaccctaaaattgcttgtgtgattagtgctgatcttggaagacttgctcagacatcgattggcagtgcggtgcagtttgaattattaagccgaacacaggcggtggcacgttttaaacaagatcagaactatctagaggatattcggagaaaggtaaatgaaacagattgatttaaatgtagatcttgctgagggctgtgccaacgaccagcaacttttacagcttgtcagttcagcaaatgtttgctgtggattacatgcgggtgattacaacgaaatacgcaaagcgattttgtgggcaaaagaaaacgatgtacgaattggagcacaccctagttttcctgatcgtgaaaattttggtagaaccaatatgcaattgccagatgatgagcttaaggcttgtttattttatcaacttggggcagtcaaagcattatgtgatgcgtccggtgtgacgatggaatatgtaaagcctcacggagcattatacaatatggcagcgaaagatcctcatttagctgcacttattgcagaaacagtgaaaagtgttgatccttcgcttaagttaatggggctttctggcagtatcatgctgactgttgctgaacagcacggtctagcgactatctctgaggtctttgctgatcgacattaccttgctgatggttcacttgtgcctcgtactcgtgatgatgcaatggttgagaacgatgaggaggctatttctcaagtgttacaaatggtgcttgaaggtactgttccaactgttgatggcggtaatgtggcaattaaagcagacagcatctgtttacatggtgatggtgaacatgcagtcgtatttgcaaagcgtattcgcagagagttaaaggagaaagggattttggttacaagttcaatttagtaagaattttactaaaaataggaatagatgttatttgttctagtcgcctttcttttggttgtttttcttttacaaagcaaagaaaaatagccttgatttctaaaacaaaacataaggaaaacacaatgtcaaacaataaccgcagtgcccttattggagcggcatttttaatggcgacttcagccattggaccgggtttcttaacccaaacagcgacatttacccaaaacttatttgccagttttgggtttgtgattttgctctctattttgcttgatatcggggctcaattaaatatttggcgaattattgccgtttccgaaaagaaagcccaagatgttgctaatgcagtattgccgggtgcggggtattttctcgcattgcttattgtgatgggtggcttagcgtttaatattggtaatgtgggtggtgcaggcttaggtttgaatattcttactggagtatctcctgaaaagggagcaattatcagcggtattattgctgttggtgtattcctatttcgtgaagctggtaaagtaatggatagatttgctcaaattatggggtttgtgatgatcgccttgactgtctttgtggcagtaaaagccaacccacctatcgctgatgccgttgttcacactttcttacctgaaaaattagatgttattgcgattgtcacccttgtgggaggtacagttggtggctacattacttttgccggagctcaccgtttattagatgcgggcattaaaggaaaagaaaacttaaaagaagtgagcagaagttctgtttctgcaatcttaattgcttccattatgcgtgtggtgctgttccttgcggtattgggtgttgtttcaatgggggtccaactggatccaaaaaacccagcctcaacaccgtttgcttacgttgccggtaatgtcgggttaatgattttcggtatcgtaatttgggctgcatctattacctctgtgattggtgcggcgtatacctctgtatctttcattacatcattttcaccattcatcgaaaaacacaaaaattgctttatcgtggcatttatcgtgatttctaccgttgtgcttgctaccataggcagaccagcccaagtgctagtgttcgtaggaacattaaatggtttaatcttacccatctcactcggtttagtcttattagcagcttataaaacaaatattgttggtaactataaacaccctatttggatgacaattgcaggggctattgttgtcgtaagcatggcaattttaagtattataactctctcaaaatatgtttttgggctgtttacttaattgatttaaggcgatgatagcaattttcggtttctctttacttggaagagaaacctttttccattatgatcttgtctaaatttaacgttgctgtgtaaacatatattgcaaatgtataaaaatctatccttacttttacttgatgatttgttcgatttagaattagttgcgggtcttactcaatgtgagaaaggtaattaccttgattctatggtagatagacaacaaggaatgagtggctatatgttgcaattaactacttttggtacaggcattattttcgatggtaaacattctttttccactcatcgaggacaattgctactattcacaccaagtgcggttcaacattatcacagacatccagaaagtcagtattggcactataaatggatctattttttaccaaacccaaaatggaataaatggttaaattggtcaaatatggaggaaaaaatagggcgtattaccattggtgatgaccgctactttcaggaaatcagtcagcttttcagcaaaattgaagtcgaattgaaatcaagtaaattttttaaagaagatgtagccaccagtctattagaatacttacttatgaaaagtatttccgccgagaaaattgaagttattccagtaattgatcagcgtattttaaatgtttgtgatttaattttgaccaatttggctaaaaatgacagcttagaagcactagcaaaaaaagtatttttatcgccatcaagattatctcacctttttaaacaatctttgggtattggcttagtgcaatggagagaagtacagcgtatttccgaagctaaaaaattactttatttctctaacatttctatctcaaatattgctaaatctttaggctatgaagattctctctacttttcgaaaattttcaaaaaacacaccgcactgtctccgtctaaatttagaactttagaaagatgtaaaaacaatgaaatgtgatccagatctcactttactttgtatagcagaattttccatattgatcaaaaaaagttacctatttttccctcacacaaaagcataagataaaaatggctttaatagtatggtttctattagagaggtaatatcaagctttttatacgatattcaattaaaggacttcttattttatgagggaagaataatgaaaaaactcactttaaaacatacattattttcaggtattttagcactgacttgttatggttcagttcttgctaatgacgtagttaatatttctaaaattgacggtatgccatggtttaatcgtatggcagaaggtgttgtacaagcaggtaaagataacaatattaatgcttatcaagttggaccatcaaatacagatgccccacagcaagtgaaattaattgaggatttaattgcaaagaaagtcagtgctatttcaattgtacctaatgatgcaaatgccttagaaccagtgctgaaaaaagccaagcaaaatggtattgttgttttgacgaatgaatctgtaggtcagccaagtgcagattgggatattgaaattattgataatgcccagtttgctgccgattatgttgaagaagtcgctaaagcaatgggcggtaaaggcggatatgttatttatgtcggtggtttaaccgtacctcaacataatttatgggcagatctatttgtaaaataccagaaagaacattatccagatatgtttgaagtaaccagtagaatgcctgttgcagaaaatatcaatgatgctcgccgtaccacaattgatttagtcaaagctcactctgacttaaaagcagtagtctctttcggttcacaaggtcctatcggtgccggtttagccgttaaagaaaaacgcttgaaaaataaattaaatgttttcggtatgatgattccttctcaagctgcaaatttaattaagagtggtgatattacgatgggtattacctacgatccagcaagtgcgggttatgctcttgctgcagttgctgccaaagtgttgaaaggtgaaaaaatcgaagatggtttagaactccctaatgtcggtaaagccaaagtggatacagagaaaaaactcctccaattccataatgtacttaaagtaaccaaagataatatcgacaacttatattaatctatattgaatatgggttctttctgaacccatatttctctcaggaggctttatggcatttattttgatgcaaaatatcaataagacattccacggtgtaaaagccttaaatcgagttaacctctctttagattatggagaagctctctgccttgccggtcaaaacggttgtggaaaatccacgctaatcaaaatcctctcaggtgtttatcaaccagataaaggggctgaaattcaaattggtgcgagcaaatataccaaactgacgccacaagcttctattgaacagggaattcaagtaatctatcaagatttagccctttttcctaatttaactgtcgctgaaaatattgcaataaatttacatcgaaaattaggttgggtcagccaatcagaaattcatcaagttgcattaaacgcaatactaagcattaatgcagatttagatctcaatgctattttagaagatttaccaattgcacagcaacaattagtcgctatttgtagagctcttgcacaaaatgcccgactgttaattatggatgagccaacagcatctcttacagcgaaagaagtacaagatctgctaaaagttgtactcaagttaaaaagtaaaggcattagtattatttttgtcagtcataaattacaagaagtaatgagtgtctctgataccgttttagtacttaaaaatgggaatatggttggacaataccctattagtgaaatggatgaaaaacgcttaggattcttaatgacaggcttggaaattgactataaacggttagatttgcccgatttttcgcaaaatagaaccgttttagaagttcaaaatttaactctgcctaaccagtatgaatccattaatttctcattaagagaaggagaaattattgccttgaccggtttactcggctcaggtcggacggaactgtgccttagcttatttggaatcactcaacctaaatcaggtgatattctattaaatggtgagaaggttatatttcaaaacaaccgtgatgctattaaacaaggaattgcttatgtttctgaagatagaatgacaactggtttaattatgactgaatccatacatcataatattatctctactatttttcataaaatcaccgataaatttaacattataaaatcatcaaaagcctataattatagccaggaattaattgaatctttaaaaattaaagtaacggattcaggtttgccagtaaatacactttccggtgggaatgcccagcgggtgtctatcgcaaaatggttagcaatagatcctagaattattattttagatgctccaaccattggggtagatattgcgaataaggaaggaatattccaaattattcgcacattagcacaaaaaggtatcgctgttatttttgtgaccgatgaggtagaagaagcatactacaacagtcacaaagtcatagtaatgaaaaaaggtaaaattgtaggtgagatattacctatctataccacagaaaaatcaattgcggaggttgtttatgaaaatcaccaataatcatattttatctacgacaattttgatactggcaaccttattaagtctattcacgaatgacttcgctaccattgagaatatctatgatgtagtcaataactattcaatgctaatgattttagcttgtgggttgtttgtggtgttactatcaggtggcattgacatctcatttcctgctatcaccattatttcacaatacattatggtaacggctataggcaaatatgatatcggttttttcggcgtatttgcagtatcatccgcaattggtatcttacttggttttattaatgctctttttgtaaaccgccttagtgtaccttcaattattatcaccatctcaacattaaatattttctacggaggactactctattttaccaagggtgtttggttatacgattaccctgaatggttcacccaagaattgctatttttcaaacaaacctcgcaagatggttttgaattcggtttatcttttcaagcgataatggcgattttatctatattattaacttggttgatcactagcaggttaacaataggaagaaaaatttatgcccttggtggaaaccaagatgccacctctcgtattggttttaatattttattccttcacctatttgcttacggctatatgggatttatggctggaatagcaggaattgtgcaatcttataccgtacagtctgttgcccctgactctctacttggttacgaattaactgtactggcagctgttgttttagggggtgcaagtttatctggaggaaaagggacattatttggcactgtaatgggagtaatgttactagcaattattcaaaatgggctgaaccttatgaatgtatcctcgtattggcaaacgataattaccggtatcattatcatcttaagtattagtgctactgcattagggcaattgaaaaaacaaggagtataacgatgagaagcaaatttgatcatactattttttatctgttggctctttttattattactgttattgcctttagtattttaattccagatattttttggtctgtgagtaactttcaatcaatggcatcgcaaattccagtcttaggaattttaactattgcaatggcattacctatgcttacgggaggaataaatctttctattattgccagtatgaatgcttgctcattaattattgcttgttttattacgaagcatgcagggatttcttggctatttctatctattgtattaagctttttatgtgcattaattattggggtgatcaatggtgcactgattgctattatccgagtttcaccgattctagccacgttaggcacaatgacattaattaatggcataaatatattagtaacaaatggttcaacggttgctggctttccagaaataatactgagtattaatacctcaacttttttatggttgccactgcctattctgatttttttattccttgctggacttgtttggtttttcttagaaaaaacttctatgggtaaagcggtttattttatcggcaataatgaaaaagccacatattactctggcattaataccaagaaagttctaatttggatatatattatctcctctgtactctgtgtattcgcagcccttttaatgatgtctaaactcaactcagccaaagcatcgtatggagattcttacttgctcatttccattttagcggcagtactaggtggatttaatcctgatggcggcaaaggaaaacttatcggcattatgttagctcttgtattactacaggttattgaaagtggattaaatatgttaggtatcagtagttatattacgatgattttatggggtagcttattactactgtttatattcttacaaaaaaatcgtcttttcctattaaaaaactaagggatgtacgttatgcaaaatgaaaaacagcttattgaacaaggtaatatcgttattggtattgaattaggttcaacccgaattaaggcagtattaattacctcagatggtactattttagcaacgggtggagcagattgggaaaataggttaattgaaggagtttggacataccatcagcatgagatatgggaaaaactacaagcggcgtatgtagatttgagtaagactgtaaaagcaaaatatcacaccacaattcgtactgcaaaagcactgggaattagtgcaatgatgcacggttatttgccttttgataaacagggaaatcagctggtgccttttagaacatggcgaaacaatataactttaaaatcatcggaaaaattaaccgcactttttcaatatccaattcctcaacgttggagtattgcccatttataccaagcattactcaataaagaaccgcatttatctgaaattgattatattacaactctctcaggttatgtgcattggcaactaaccgagaacaaagttttaggaattggagacgcttctggtatgttcccgatagatactgagatgcaatcatacaataaaactatgctgactcaatttgagcaggctattattgaatatcagatgccttggagattagatgccattttgccaaaagtattagtagctggagaacatgcgggtaaattaacttttaaaggggctaaattacttgatccaacaggtaacttacaggctggtattccactttgtccgccagagggtgatgcaggcacaggaatgattgcaaccaattgtatcaaagaaaaaacaggtaatatatctgctggtacatcagcgtttgctatgattgttttggaaaaagccttatcgaaagtctattcagaactggatattgtaactactccggcaggtaaactagtcgcaatggcacatgcaaataactgtacttccgatattaatgcttggataaatttattcggtgaatgtttagctacttttggtgtttatgtgtgtatggaagagttatatgaaatgctttttctgcatgctttgcaaggtgagccggattgtggtggattactatcttacggtttttattctggcgaacataatgttggtttatcggaaggttgtcccgtttttttgcatccaaccaaagctcgttttaatttggctaactttatgcgtacgcatttttatactgcttttggtgcaatgaaattaggaatggatattttgattaatcaagagaaagtggaaatttctcgtattctagggcacggaggtatttttaaaactgaaggggtcgctcaaaaaatattgtcttctgcacttaatattcctttagcaactgcaagcacagcttcaaatggaggagcttggggtattgcactgctggcgaattttcttaccatttctaaaagatataatttggaagaatatttagataattgtattttcaacacaactaaacttaatcttattcaaccggataaaataatgagtgaaggctatgaacgatttatgcaacgttataaacaaggtatttcaattgtggaaagtgcactttttttgaatcagtaaagttacaagcacatagaaaaagcttatgttgtgacgggctgaatcggttgtagaacatctgcccataattggttaataatgttacttaactgttagggcagattgatttttacgtgtatgattatgcaaaatattgtgctagatcgtcacttccgccaatatattgcccaccgataaacacttgtggcacacttgttttacctgtgattgcacgaacagaaattgtactcgcatcacgacccagtatgatttcttcaaaggtatagcccttttcttttagcaatgtttttgcttttgcacagaatggacagccgggttttgtgatgatggaaactgaaggtttttctgtccaatttgggtttaagtatttaatcattgtgtctgcatcagagactttaaatgggtcgccgggttcttgtggttcaataaacattttttcgactacgccattttttaccagcatagaataacgccaagagcgtttaccgaaaccaagttctgttttatcaacaagcatgcccataccgcttgtgaattcaccattaccatcgggaattactgttacattctcactttcttgatcagctttccaagcattcataacgaatgtatcgttaactgatacacaaataatatcatcaacacctaacgctttaaattcacatgcaagttcgttataacgaggtaaatgtgttgctgaacaagttggagtgaacgcacccggtaaagaaaataatacaaccgttttattgtcaaacaaatcggcggttgtaacatcaacccattgatctccttggcgtgtacggaatgttacttgaggaactttttttccttccatagtcataattttttctcctatataaagattagttgataaaaaatatgattttaagtttaaactatgttatagtcaaaaacaatcaaaaaaagttatttaattgttaatttctatgataggtgtacagaatgaatattcgagatttagaatatctagtttctttagctgaacataaacattttcgtcgtgctgccgatgcttgttatgttagtcaacctactttaagtgggcaaatcagaaaattagaagatgagttgggtatcgtattactagagagaacaagccgaaaagttttatttactcaatctgggttgcttttagtcaaacaagctaaaactgttttacgagaaataaagctattgaaagaaatggcaagtaatcaaggtaaagaaatgaatggaccactacatatgggtgtcattccaactattggaccctatttattaccctatattgttccggcactaaaaaatacttttcctgacctagagctatttttgtatgaagctcaaacgcaaaagcttttagaacaattggaaacaggtcacttagattgtgtcatattggcatcagttgatgaggctgaagcctttattgaagtaccgatgtttaatgagagaatgctactggcagtttcagacgaacaccctttatcaaaagaagattcgataaaaatggataagctgaaaggatatgaaatgcttatgctggatgatgggcattgtttacgaaatcaagccttagattactgttttgctgctggggcaaaagaaaatcagaattttcgtgccacaagtttagagacattacgtaatatggtatctgccaatacaggtattactctcattcctgaactggcactcttaaacgaaggttcgagaaaaggaataaaatatctgccatgtttctctcctgagccatctagaggtatttctcttgtttatcgtccaggctcccctctaagagggcgatatgagcgaatagccaataaagttagtgaaataataaaacctttactaaataatagaaaaaacggtaattgaggtataacagctatataatagctgtataaatatctaattgtttggaaaaactaaaattacatcagggataattctgttggcctttaagtccgctatagcaattattaattccagtttgtttttaggctatttttttaataagtcacgaatctctgttagtaatttttcttcgtttgaaggtgtaattaccttttctacttttggttcttctttcttcaatttatttaatgctttgatcattaagaaaattgcaaatgcaataatgataaaatcaaatatattttggataaacataccatattttaacgtcatagccggagttttatcggttgcttcttttaaaacaatatgtaagtctttaaaatctacgctactggtgaaaaaacttaatatcggcatgatgacatctgctactaatgagctgacaatcttaccgaatgccccaccgataatcacaccgacagccatatcgataacattgccccgcatggcaaactcacgaaattctttaataaaactcatcacatactcctaaaataaacaaatataagtttgaatagatcgtaaaaactttcagtttgatgtatagaaaattgatattattctctaaataaagaaagcattaggttgaaaaagtttctctatttctgttacatattttttatcacttaaataaacaatgatatgatcgccactttcaatgactacatcttttcttgcgatgatcacagtatcttgtcgcaaaatcgcaccaataattgcaccattgggtaattttaactctctaagtttacgtccaattacttgtgatgttgtttcatcgccatgcacaataatttccaatgcttcagcaatgccatgacgcaaagagatcgcatttgcaatatctcctttacgtacatgccccagtaaagcggagatggtagcttgttgtggagaaactgcaatatcaattgttccgccttgaactaaattgatgtacgccatacgctgtattaacaccattgcttttttagctccaagatgcttagccaagaatgccgacataatatttgtttcatcatcactggttaaacataagaaagcgtcaatgttttcaatatgttcttcaaacaataacgatttatcggaaggatctccatgcaatactaaggttttagataatttttccgcaagtgatgttgcacgctctgcattacgttcaataagtttgactgtgcagtgattttccagtttttttgcaacacccacggcgatattacctcccccaataatcatcactcgtttataaggtttttccaagcgttgcagttctgacatgaccgctttaatataaattgttgcacaaataaaagttacctcatcgccggcttcaataattgtcgaaccctgcggacgaatcactttatcttgacgtaaaatagataaaatacggcaatcaatatgcggcatatggtcttttagggcggaaagagaatagccaaccaaagggccaccataataggcttttactacaacaatactaatattttcattagctaaatgagctacttgtaatgcaccggggtaatcaattaagcgagagatttcttcagtaacaagttgttccggtgaaatgatatgatcaatagggatcatgtgcggttgaaataatttatctttttcacgccaatattctgcatcacgaatacgtgcaatttttgtcggagtgttaaataaggtataagctatttggcaagaaatcatatttgtttcatctgaacttgtaacagctactaataaatctgcgtcaggtgctcctgcttctcgtaaaattctcggtgatgatgcagagccgttaatcacttttaaatcatgtttatcttgtaaatgtgccaaacgaacagcgtcattatcaattaacgttatatcattgtcttcactcactaaattttcagcaagtgttgttcctacctgaccggcacccagaataataattctcatcaattccctcttttaatttatacagattgaatacctttatttttcatattttaacttcacattaatttctgataagttttatgattaattgggcagttttcttaatttggcataataaaaaccgtcacctccctgttctgttggaacaaattgatgaccaatttcctccccaatggtaaaaggcaaaggttctaattttgcatcattgtgcttggctaagaaatgctgaatttgttgactattctcttcaggtaataaagaacaggtcgcataaactaaaataccttgtggttttaattttttccaaagggcttctaaaatttgtccttgcaattgcactaggggagtaatatcactttcttggcgtagccattttatatcagggtgtcgacgaataacaccggtagcggaacaaggagcatctaataaaattcggtcaaattgcaccgcactttcagatttaaaggtcagtcctatagcattaaaatcaatctctgataaccattgctccggctgggttgcatcaccacaaattattatagcttgttgtttcatacgaactaaattttctttcacacgttgtagacgagcaggttcaatatctaaagcgatgacttttgcgttgggtgcttgttctaaaatatgtgtagtctttccgcccggtgccgcacaagcgtctaaaataagttcgttatttttcggttcgagtaataaggctgaccattgtgcgtgtagatcctgaacgctcacccatccttgttcaaaatagggtaataaattgaccgcacttgcttgatgtaggcgtaatgcttgcgggtgattcgctgttgatgtagatattcctcgctccattaaaagttgttgataatccgcaatagaacaatgttgtaaattaatgcgtagccacatcggaggtttttggttattcgcttcaacaatttcacgccaattagcataagattgttttagtttattcactaaccattccggatgtaaggtttgccaatgcttatccactatcgccagaatttgttcttgttcccgcaaaaagcgacgcaaaacagcatttaacaggccacggaaactatcggattttaaacttttcgtggcagaaacgacttcgtccactgcagcatgagcaggaattcgggtatataaaatttggtataaaccgaccaacaacaagcagtgtacgatccgagttttacctttcaaaggcttatccagtaggagttgaatgatgcgttctaatcgaggtaacacacgacaaataccaaaacaaatttcttgtagtagcggaaaatcctgcggtttgaccgcactttgttgctcaggcagcaaggtagaaagagatttaccttgaactaaaacttgtaaaattacttctgccgcaagcacacggactgagcgaggcgtgaaaagtgcggtagatttgaccgctcttttagttttgttgtgctgagatttgctcataggacttgtcctatcttaaaccaatccgcacggctgtttaataaatctcgtgccgacatcggttttttgcctgcaggttgtaattgctccaagtttaatacaccatttgctgtcgctacttgaatacctcgtttatctgctgcaagaatggtgccacaaggcttatcttgatgaggtaacactgaggcttgataaacttttaacgtttgtagcgtgccttgactgtcttgtgttacaaaataactcattggccatggattaaacgcacgaatacaacgttctaattgttcagcggataaagaccaatccagtttagcctcttctttagaaagtttttctgcataattactcagactttcatcttgtacttccgctttaaatagaccttgttctaaaccgtccaaaacctcaagtaaggcttttggtgcaatgttagccaatttagtgtaaagggaggttgaggtttctgtcggtgtaatatcacaacagactttatgtaacatatcgcccgtatccagcccctcattcatttgcataatggttacccctgtttttttatctcctgcccaaattgcacgttgaataggtgctgcaccacgccaacgaggtaaaagcgaaccgtgtacattgagacaacctaaaggaaatgtttgtaacacagccaaaggtaaaattaacccataagcaacaactaccatcacgtcggcattcaaattactcagattttcttgcacctcaactttacgtaaggatttaggttgataaacgggaatatgatgtttttcggctaaaattttaaccgcacttgcccgcaatgtttgtcctcttcctgcaggtttatcgggctgcgtgtaaacagcaaggacattatgttgagattggagtaacgcttgtaaatgttgtgcggcaaaatctggtgtaccggcaaaaataatatttaatggtttcataagataagctaatgttctacgttatgtaattgataaaaataaaaggcggacaatccgtccacctattgtttaatttaacgattttttgcgatttgtttttgcaatttgagtagtttttctttcatgcgttggcgttttaatggcgacaaatgatcagcaaaaacaataccatttaaatgatctatctcgtgttgaatacaaatggccaacaaaccatctgcatctagcataaactcttctccctgacgattttgtgcttttacttttacagtctctttacgaggcacaaaaccacgtaaaccgggtaatgataggcaaccttcttcaatacctgtttcaccgaaactttcaagaatctcagggttaatcaacacaatttgattttctttagttccttcaatatcgatcgtgataatacgcttatgtacatttacttgtgttgcggctaaaccaatcccttcttcgtgatacattgtttcaaacatattatcaataaaggtttgtaattcttcgtcaaaaacgcttacaggttctgcgaccgtttttaagcgttcatcgggataaattaatacattcaataatgccataagttcctttcatattttatgttataaattcaaattgaattcattttactcgtttttataggcttttttaagaaataaaataaggaaatgggaaaatatctcaactgagatgcgtaaaaaacttcagcgagagcgatttaccggcaaaagagcggtaatttctaccgctcttttttgggaattgtgttatacgcctttatgttggaagtacaaaactgttgcggcaacccgagaatgaacgtttaatttacgtaataaattgcgaatatgtacttttacagtttcctctgaaataaataattgtcctgcaatttgtttatttgctaatcctgtcgcaatgagtgccagtacattcatttcccgatctgtgagggaataaataggatcatctttatgttgacgttctaacagtaaatttttgatcgattcactgagaatgacttcgccttgtgtaactcgttttatctgagagagtagggtatccggttccgtatcctttaataaataaccgtcagctcctgcatcgattaatgtgaaaatatcatttttcgcatcagaaacggtaagtattagaattcttgcatcaattccttctgtgcgtaaagcctttaatgtatccagtccggataatcctttcatatttagatctaaaatgatcaaatcaggttctaactgcaatgccagatttacaccttcacttccacttccggcgtcacctatgacttcaaaagattcatccagctcaagcaattgtttaatacctcgtcgcatcaaaggatgatcgtctattaagagtacttttgttttgtcagacatcgattttgtcctcatcatgagagtgcaaggcggctatgaaaaggcacaatttttgttccaccgttgcagtccggtaataattgataaaattgcggatagttaaaattatgctgcacgattttatatgggttgttgtttttatccaagctcgccgattgataaatttgatttatctcacgaattttctgttcttttgagccttcacaatgtcgatagatttcaatgtggttttgttcgtctaaaatatagacattaaaacttttatcttcattatcttcaaagaaaaattgtaagaaaccttcgctcgcaaaagcatccatttcataaggataatgtttctgttctgctaaaagtgcggtttctttttcctcaatagtattacgtagttcattatcaaatacactattatttatcgaagtgttttgcatttcctgtaagctgagtccacgctcttcaaagaataattgccagtttttacccgctattctcaacatattatttttgggggcatcggtatcaccaattcgtatatcaatatattttttgataagtgcatggacaatattgcataaggttttttggtagtgttggctgtaacaaaagacgttaattgattttggcggtgttgagccgggataaattttgtttgataacacttttaatgctaatagaatggcattggcaccctcaaaatgcaaagtgcggatctcattccagatatttctataagtgaggtcaatacttcctacgagactttcttctgaaggcccaaaactgaataagtcacttggtaaaatagtcgacttactttgcaacaaatgagcagttggatcgttagttaaattgattgtaacggagagatgttttattttgcattgttgagttaattccttatttgttgcttttttagtacgggtaatagggaaagataaacgcaaatcagcaacgaaattacgtagcgttttaagagatacagtatcactatgaatataaagcgaagtgattggtgtaagcaacccattaaaataggcccatgaaactaatttatttagattttcgccatattctatgtggcgtttttgacaaagtccttgtacatccggtttttgtgttactaaataccaaccggctttgaagaatttattttgtttcacttcaatgaatgttaagtgcggttccgataaatcaagagaaatagcttgattgagcaaggtgatttttcccggtaattcttcaaaagcggtgtaaagttttctggtcaagatagaaacatcttgtggcatgatactggcatttacattatgtttacgcccgaagttaattagatttcgatagctcaacataaggtattgcatcaggtcattgtgactttccttaacttttttgattttccaagttgtacgttgatttagattttgaagaagattatctgaccaattccactgctgtgtaagttgatgcagtttttctgaacgccaattattttcttgttgttgaacgatatactcactggctttcatataaaagcaacgtctcacaaaatctaatcttttgaattcattcagttttgttaaaaaagaactcactcgctccaacattgctaagtatgggtcatagtgatagtcaagatcgttattcagcagacgttgtttgagttcttgtgcaattaagtgagtatttggatattcataagaataactttcgagtaataagattttgagtaccgatttatagggggaatcgatacctttatatagttgccatagacttgcaccaaaatattcgttcgctgaaaacgcactcagacaaccaaaatctacccaatcatctatattgatttgctttgttttgatgagtcgattgacttcagaactataatcttgttcatttgctacctttagatgtaaccaaagtagcggtttaccggcaaggcgaataacagaacgatagaactcctccagtaataacatatattgtgcggagccactattttcagaagtaagtgcatcggcataacgaaagctacgaaaacgctgttggtcaattaaataaagattaatttctacgccaagacttcttgcccattgttgcaataagtgatttttttttgaaagttgttctttatcttctaagctaagatcttctcggtggcatacccaaatatctaaatctgagcttggtgtttggctgatagaaccgatacttcccataacgtaaacacctaaaataggcgtgtctgtgagatgttgtaatgctgccaaatgtgtactaagttgctccaaatctccctgagggagatgtgtagttaaaaattcctgttggtattttgataattgaaaacgagcaatgccatgtggggcattcggtaggtaaccgcccatcaagggatgatttatgtgtaacaataaggtaagaagttgtaatacacgttggaactctactgaagttgaagatagtgctctttctaaacgtaactgatcaacaaattcaacttgtttcttcgcttgttggagatcgtatttcaagttattctctatctagataaattaatcgttgcttactctatcactccccttgtatgaaagcaaaaaaatcaagtaaaaaattaaatctacactgacatttcagagtaacagtgataggatattgcgattacgagtctaatctatatttctacatatgagtatcaacaagaccctaaaaattgcgacacgtcaaagtccgttagcattatggcaggcaaattacgttaaaaatcgcctacaacaacgttattctcatttaagtgtcgaacttgtccctatcatcacaaaaggcgatgttatcttagatacacctttagctaaaattggcggaaagggattatttgtaaaagaattagaaaatgcgttgttaaatggtgaagcggatattgcggtgcattcgatgaaagatgtgccaatgcaatttccgaaaggattagagctaagtgtgatttgtccgagagaggatcctcgtgatgcatttgtttcaaataagtaccgcactttagacgagttaccgcaaggtgctattgtaggaacatcgagtttacgtaggcaatgtcaactcaaaaactggcgagcggatctcgatatccgttctttacgtggtaatgttggaacaagattaaataagttagatcagggtgattatgatgcgattatcttagcttcggcaggattaattcggttaggattgactgaacgtattcgctcttttattgaaattgatacgattttacctgcttgtggacaaggtgcggtaggaattgagtgtcgggtagatgatcgagatgtgcaatctttattgatgccgttggctgatcagacgaccacttattgcgtattggcagagcgtgcaatgaattttcatttgcaaggtggttgccaagttccgattggtgcttatgcaattttagagaataatcagttatatttgcgtggtttagtgggagatgttcacggttcacaaattctatcggcagaagggcaatttgaattatctcttgattttgaatcatcgcaaagtgcggtgcaaaaagcggaagaattaggcgtgagtattgctgaacaattattacagcaaggtgcagataaaatcttacaggctgtttatcaatcataattgagtaagaggcaatggcagttttaattacacgacccggtgagcgaggagagcgacttgttgagatgcttaataaagccggaattatggcactccatttaccgcttatttccattatagcggggcaagaattaaatcgattacccaataaattacaacaattaaattgcggtgattatgtagttgcagtatctaaaaatgcggtggaatatgcacaaaaaaccttaagtgcggtaggtttttgttggcgttcggacttatattactttacggttgggcaacgaactgcagaatattttgcgagccaaatagaaaattcggtgtattatcctgttgagcaagaaagtagtgaaggattacttaatttacctcaaatgcaagaccttcaggcacggaatattttgattttgagagcgaatggaggacgggaattttttactgagcaggctattttgcgaggagctaaagttgaaactctggaatgttatcaacgaatgcccattgaatataataagttggaaaaaattagtttatgccaacgtattggggtagataccattgttgtaacaagtcaagagatgctaaattacttagtgaaacttgtgccaaccaatgaaacaggctggttattcagttgtcgtttagtaacggtaagtcaacgtatagcggcattggcaaaaagtgttgggtggacaaatattgttgtggcagataaagcggataacttgagtcttttccttgcattgcaacaatgaaggctggaatttcatttgattaaggaataaaaattatgacgaagaaacattcaaaggttagcacagaaaaacaggataatatatccgtgcaaaatcctcctttggaggcagaattgcaatatgaggaagtaccggctgaggatattgtaaagcaagaaagtaaggctaaacaggaaactttttcaaatcaggagcattttatggaaagagagaatgaacaagttggcgaaaaaagaacagcagctcaagttgaaactgtagtggtgaaaaaaggagggacagtcattgctctattagctttgcttattgcattgggtattgggggagctggctattattttggtcaacaaaaagtagaagaaattcagcaaaagttgaccgcacttagccaaccgtcggaagctgtgtcgccggaaaacaatgatactttgttggcaacagttgaagaatataagcaaacttttatacagaagattgagcgactggaaaatgaaatgacaaaacaaaaccagcttattcaaagtttacaagcacaagtaaataaattggatgcggttggtaaagttgaacaatcgacggattggttgttgtttgaaacagattatttgttgaataatgctttacgtaaaatcgtattggataatgatgtggagacagctattgcgttattgaaagtggcggatgaaacactcgttaaggttaatgatcctaaagtcattaacattcgtcaggcaattaatgcagatttaaaacagttattatcagtaaataatgtagatcaaaatgccatcatgcaacatttatctcaattagcaaacggtattgatgaattagttgtattaaatgtgaatttcgatgagcaagaaaatactcaattaagcgattccttacaggattggaaagaaaacgtagaaaaaagtgcggtatcttttttaaatcattttattcgtgtaaaacctcgccatgtgaactcaaaggaattacttgcaccaaatcaagatatttatttacgtgaaaatattcgtttacgtttgcaaattgcgattatggcagtacctcgtcagcaaaatgatttatataaacaatcacttgaaattgtaggttcttggataagaagctattttgatacaagcactgaagtggcacaaaatttcttgaaagagattgatgaacttgctgagaaatctatctatgttgatgttcctaaccaattaaaaagtttgcttttgttggataagttattgaataaggaacagtcatctgtacaaaaaattgaaatgacagtagataaagacttggttagctcaacagatcaagtatctgaggaagggaaaacagatcaagctgttgaaaaatctgatgaaaagccaattgaacagcctgttgagcaagcacagtaataggagaatagcgtatgttcagagttctatttttaatgctggttttattggctggattaattggcggtccctatttatcaggtaaacagggatatgtgttaattcaaacggcaagctataacatcgaaatgtcaatcacgatgttggttattttctttgtgattttaatggccattgtttatctgattgaatgggtggttacacgtttcttccgtttgagtaataatacctatagttggttctctcgtcgtaaacgtgttaaggcacaacgtcaaactttggaaggtttagtgaagatgaatgagggcgattattccaaagctgagaaattgattggaaaaaatgctagacattcagataaaccgatattgaatttaattaaagcggcggaagcggcacaacagcgaggcgatgattttgttgccaatcgctatttaattgaagcaacagaattagcaggtacagacagtttaattgtcgaaattgcacgtactagaattttattgcaacaaaataaacttccggcagctcgtagttcggtggatagtttactggagatgacctctcgtaataaagaagtattaaagctggcagtgaaaatttacctgaaatctgccgccttccacgcattggataaaattctagatcaaattgaaaaagttggattatattcttccgatgaattcaccgcacttcaacgtaaagtcgaagatggtttattagacgagaaaatgaacgaagagggtgttgatgggttattacgttggtgggatgaacagcctcgtaaacgccgtaatgatttatatgttaaggttggtttaattcgtcgtttactagatagtgatgatcatgaaagtgcttatgagttagctattgatgctctgaaaaaagttgaaaatagtgttgaagctaatgttgctctttgtactcaaattactcgtttacaaccagaagataacagtaagttattaaaacttttggaaaaacgtgcaaaacagtcaaacagtaaagattgttgctgtgttgaacgtgcgttaggttacctttatgtgcgtaatgatgatttcgctaaagcggcagaagcattcaagaaagtgatagagaataaagcgagcttacaagcaaatgatattactatggcggcttatgttttcgaacaggttggagagcttgaattagcacaaaaagttcgtgaggaaggattgagaaatgcgatgtcaattaaagagtcggaaaataaaaccaaaaaaacagcagaaaatccgaccgcccttttagaacaaaaatcctaagtatattgttaaaaatgcccttaaaaatcattgttaagggcatttttataggttttatttttcctcaatgaaagttaaggctttttcaataacctccacaccggcatgagatttatggatgttttcactcatatagcgtcgccattgccttgcccctttacattgttgaaatgcacctaataaatggcgagcaatatgattaagataaacgccttgactcaattgttgctctatgtaaggaaacatattttctattgcttgtcttggcgtgataattgcacaagacggatcaaataacgcttgatcaatatagcccaataaagacgggttttgataagcttcacgcccaaccattactccgtccacataattgagatgtcgttgaatttcttcaagcgttttaattccgccattaatgctgatcaataaatcaggaaaatcctttttcaactgataaactcgctcataattaagtggcggaatttcacgattttcttttggacttaaccctgataaccatgcttttctagcatgaataataaattcttggcaaccgatattatgtactttttcgataaaatcacatagaaattcatagctatcaaactcatcaataccaagacgagtttttactgtgactggaatattgaccgcactttgcattgcgttcacacattctgctactagagcagcccttgccatcaggcaagcaccgaacatcccattttgcacccgatcggatggacaacctacattcaagtttatttcttgatagccacgttcttcagctttttttgcacaatattgcagtttttcaggatcacttccgccgagttgtaatgccacggggttttccgatacatcataagcaagatgatcgtatttggcatgaataattgcaccggtagtaaccatttctgtatagagtaaggtataccggctgaactgccgatggaaaaaacggcagtggcgtgtagtccagtccagcataggagcaacggaaaaacgacctcgataaaagtgcggttgattttgcttcattttttacttgtttgataattgaaacggttagggtttagcgttttcgtgagcttttctctttttgtgcatgccgacggaaacgcccacgcctaaatgataaagtaatacaggattaatttggcgtgaaacaaaagccgttacaatacaatcaatgaatgcttaaatcaagccaatttgatgagttgttattgttggtttaaggattgcgtacttaccactcaatatctgagctaatacggtatgtctaagagagaataatcgggttattgcttagatttaatatgaaaggtaatttcatgaggtgaagaaattccggtagattttagtcacttgactggaaaagtgaagtagcaacgtaaagaaaaattggtatactctttttaagtttacgttgctgtcgttttagatatttatttaatcccaggagctttccaaagcgaaatggttagtcctctgtcaaccaatttcaattgctgctggtatatttcttgccatttttctttatgtatttgatataaattatgatttcttgcatttggttgatgttgtctttcaaattttactaatgttttacctgcttcatgtaatgaagtataaataccagcacctactccagctgcaatggcacatcctagagcagttgcttcttttactacaggtacattaacaaccaatcctgttacatcggctagaatttggctccataatttcccttttgcaccacctccggcaaaaacaatactggtaagattaacttggctgaattgctggacttgatcaagattacatgaagatacaattgctgcattttcttgtaatgccctaaacaggactgatttgttacatttttcaggatcaatcgaaaggttaataaatgatggggctgcgtgataccaagatttgaaatgcatagcatcagagaatacaggaataacatcatttgaacctacgggtatcttttctgccatttgttccagtaatgtgtaagcatcaacacctaagcgatgagcgacggctttttcttcttcacagaaagcatctctaaaccaacgcatagtaagccctgtaaagaagctgatagattctgcttgtaccatcggtgcaatgacatgcggattgatgcgtatattcattttaggatctgtcattgcttgtggtaagtttacgacctgttgccagaaagttcctccaataatagcagcttgccccggttctgtgatccctagtccgatacaacctaattgcacatcaccaccaccaacaacaataggcgtgccgactattaacccggtttgctgtgcagaatgggcggttacttgaccgagtatttcacctgtctcttttactttcggtaaaatagcaggattgagtccagccatctctagtaaagtgtgctcccattttcgggtttttaggttgagaatgccggttgtgccagcatttgaaggttcgacggccagttctccgctaagcataaatcctaaccaatcgctaatcatagagagaaaatggacttgagcataaagattaggttgatgatgtgcaagccaaagtaaacggggtaatgcacttaatgccagtgtttgaccggaggattgataaacttgttgttcaaactgatactggtttagagactttaattgaataacttcttctacagatctggcatccacattaccgcacgcccaaatcgggtttttattggcatcgtataaaacaatgccttcacgcatagagcaagtcgatatagctataatttgtttagcatctatttggctggtagctaaaacttcttgaatacataagcaagcaaggtgccagttattttgtaaatcaaagcccattgagcctgggatattttggtcggaaatatgtgtccattctttttgtgacgtagcgatttgatttccttcaagatcaaaaataactgcacgaatactacctgtgccggcatctaatgccattaaataacgggataattgcattatgttttcctccgattatctgaggaaaatcgttacactactttagctaaaatagtgcgtgcggttttttcctctgtgactaatgaattgatatgctgtcctaaaagtgcggcaataattgcttcaactttatcttcaccaccggcaacgccaataatagtcggtattcgcttgatactatctaatgaaacgctgattaattcctcgtgaatcggcatatccggttgaatgtttccattttcttgtaagaaatagcctaaaatatcccccacagcacctttttgacgaaattcatctagttgtttttcattgatgatataacctgtttgaagcaaagtggagcgtgttttctgaaccgtagatccgataccaacgacggcaacatcagccatactggctgctaacataatatctcgtacatacccctctttttggaaaagttgtgcagcttcaggtgaagaagctcgtagaggggcgggaataatactgatagcacagctactatcaagttgcccaatactttgcatataaggtccaacaccgccggttaaggtgattaacttaatctggttttgtttaataaaatcattgcagtgctttaccgtgtgcatcacggtgtcaccaaacccaaaagagagaacttgctttgctttgagtaatcccatcaacatttgagaggctccgacacctaagcgggcattgacttcataattctgtaactctggcaacacacgaatatgctgtaaatgaaatcgctgttttaaagcttcttctagttccaagcatcctttataacgagagttgatttgaactttgattaagccgatttgtcgccctttttccagtaagcgtgaaacttttaaacggggcaagcccaatttctcaccaatttcattttgtgtcagattatcgtggtagtagaaccacgcaatgcgtgctaataactcttcctcgttaaagccagactcgtagtgattatctaaatttatcatttttttaccctgtttttattattcatctgattttaattttaatcaaatgttctttttctaaagtgtgaattcgatcacattttacatttaatgtgaaaaaaagacataaaattcttaaaaatgtgaagtttatcacaaaaaaatagaattttttgggttatgatttggaacaaatgacaattaaaattttcatttgttcaatttgaaggggcgaaaatgaaagagacagaatctaatcctacgcctttactggaagcttgtgatgtaagtaaagctttctctggtgttgaagtactaaaatccattaacttttccctttattctgggcaggtgcatactctacttggtggaaacggtgctggcaaatcaaccttgatgaaaattattgccggtattcagctgcaagataccggtacgttaaaaattcatggcaaagtccgaaccaatttaacaccaagcaaggcacatcaattaggtatttaccttgttccgcaagaacctttgttattttctaatttgagtgtcaaagagaatattttattcggtttgccaagaacaatggatttacagtcaaagctcacagcgttgttgacggaactaaactcacatttaaatttggatatgcaggctggtttattagatgttgctgatcagcagttagttgaaattatgcgaggcttaatgcgagatgctcagattctgattttagatgaacctaccgcctcattaacaccagtggaaaccgaaaatttattcggacagataaattccttactcgtcaaaggggtagggattgtttttatttcgcataaattgtctgaagtttggcaaattgctgattgggtgagtgtaatgcgagatggttacattgccttaagcgagccaattgacaagatcaatcacgacgatgttattcaggcgattactcctcgagctaaaaatgcatcattaacagaaagtcagcagttgtggttggatttaccagggcataagagggtgaaatcgaccgaatttccattattgacagtagaaaatttcactggtgaaggattccgagatatcaactttgaaatttatcctggcgagattttaggattagcaggcgtagtcggctcaggtagaaccgaattagctgaaacgctgtatggtttgcgtaaagccaaatccggtaaagtgatattttgtgatgagctaattaattcactgtccgttaagcaacggcttaaacgaggcttagtgtatttgcccgaagataggcaagcctctggattgcatttggattcaccattaagttggaatacctgcggattaacctatcatgatatgggcttttggattgatgagtccaaggagaaagcaattttagaacgctattaccatgctatcggaataaaatttaatcatgttgagcaatcggtacgtaccttatcaggtggtaatcagcaaaaaattttgatcgcaaaatgtttggaagccgatcctcggttgttgattgttgatgagccaactcgtggcgttgatattggtgcgagagcagatatttatcaattaataaaaagtattgccaaacaaaatgtagccgtgttgttcatttcatctgacttggaggaaatagaacaaatgtctagtcgagttttggtaatgcacgacggtaagcttagtcaatcgttgaaaggtgaagatatcaatactgataatattatgcgactggcattcagtagttaggaggcattatgtggaaatttattcagaacaatcgtgaattaactattttagctgccattttgttgttatttggattgctaggtgtggcggatgactttagcttacaaactctcatgatgatttttaactcgacccaaatattagctttgttagctattggtgcgacctttgtgattttaactcgtaatattgatgtctctgtcggctcaattatgggattaagtgcagtagttgttggattagtgctaaattcaggttattccctactgattgcgtgcactattactttactgtgcgggattattgcaggtggggtaaacggtgtattagtctcagtacttagaataccagctattgtggcgacattggggacattgggtttatataaaggcttaatgttagtattaactggcggtaagtggattgaaggtttgccacattcattgaaaacattgtcagaagaaattgtattggggttttcgcctattgggttagctgttcttttcctcattttagtcacgtactacttttttactcacacttatattggtcgttgtttttatgcagtgggggataatttacaaggtgccttgcaattaggtgtaaaggtgaatgttattcgcattagtgcatttgcagtaaacggtctaatggctgctttagctggaattatttttgcttctcaaatcggttttgtgccaaattcaactggtaatgggctggaaatgaaagcaattgcggcttgtgtattaggtggaataagtttactgggtggtgcaggtaatattattggtgctgtattaggggcatatttcctgattcaaattgatacgattttagtactgatgaaagtgcctgcctattggaataactttgttgctggtgtggttctattagctgtattggtatttgacggtagaatccgagtaatgattgttaataatatcaaacaacagcgttatgcccgttttcttaaagataattcattgcaggagaatcaaaaatgattaagaaatacagctgggaaatagctctcttttgtctactgatactggaaattatcgggttcggtttggttaatcctcggttattggatctcaatgtcttatttaacagcaccagcgattttatttatatcggaatgttggcattgcctctaacactgattatagtcagtggagggatggatatttcatttggatctgtagtggggctatgtgccattactctcggcgtattatttagactaggaataccgttaagtgtagcaattgcggtgacatttgcagtcggatcattgtgtggtgcgattaatgctgtactcattatctatactcaagttaacccgctggttattacgcttggcacaatgtatctgtttggtggtggtgcattgttattatcaggttttgctggtgcaacgggctatgagggtattggtggatttcccgatgtgttacttgattttgcaaatctcagttttggtattattccaacaccgattatttatttcttaataatgacatcactgttttggctgttgatgcatcgtactcgtattggtcgtagcacatttttaattgggcaaaatttacgggtctctaagtatagtgctgtaccagttaatcaaactctatttattatttatccgttaattggtttgattgcggcttttgtcggtgtgttgctggtatcctactttggttcagctcgttcggacttagggagttcgttgttaatgccggcactaaccgcagttgtacttggtggtgcgaatatttacggtggttcaggttcagtgattggtacagcaatagctgcattattgattggctacttacaacaagggttgcagatggttggaatttcgaatgaaacatccagtgccttgtccggagcattgttgattattgtacttatcgggaaatcgcttaatacacatcgggcagtagtgattcaatggtggaatcgaatccgagcagtttaaaataagcggttagtttatgatgatttttgtcaaaattgactgcgataaaacccctgcatacttgttgttttggtatgttttttaatcatacactcaattgaggagacgttctatgaaatactcacttttaaaaacaaccgctcttgccgtagcgttaggttttaccggttttaacatagcacaggctatggataaggtggcatttatcccaaaattagttggcgttggtttttttaccagtggtgggcaaggtgcggtcgaaatgggaaaaaaattaggtttggatgtaacctatgacggtccggcagaaccgagcgtatcgaaccaagttcagatgatcaataactttgtgaaccagggttataatgccattatcgtctcagcagtatcgcctgatggattgtgctctaccttaaaaagagtgatgaaaaaaggtgtaaaagtattaacttgggactccgatactcagcctgagtgccgaagctactatattaatcaaggaacacctactcaacttggctcaatgctagttgaaatggtatcaagtcaaatttctaaaccaaaagcaaaagttgcatttttctattccagtccaacagtgactgaccaaaaccagtgggttaaagaggccaaagcaaaaattgaaaaagaacatcccaaatgggaaattgtgacgacacaatttggctataacgatgcaattaaatcgctgcaaactgccgaggggatcttaaaagcctatcctgatttagatgcgattattgctccagatgccaatgctttgccggctgccgctcaagcagttgagaaccttaaacgacaaggtacaatcgttgtcggattcagtacgccgaatgtaatgcgtccttacgtaaaacgaggcacagtaaatcagtttggtttatgggatgttgtgaagcaaggtcaactctctgttgcagtagctaatgaattgttaaaaggtaattctcttaaggttggcgataaattgaatgttgatggtattggtgaagtagaagtatcagcaaataaagtacaaggctatgagtttgaagcaaagggaaacggtattgtgttactacctgagcgtgttgtattcactaaagataatattgataactatgatttctaattatataggagacaatctatggcagatttagatgatattaaagacggtaaagattttggtattggtattcctcaaactaacaagctttttttcgtcaaaggttccagtgcattagattggggaatgcaatcacgtcttgccaatatctttaatcccaaaacaggtaagacaattatgttagcctttgatcacggctatttccaaggtccgacgacgggtcttgagcgcattgacctcaatattgcaccgctctttgattataccgatgtattgatgtgtacccgtggtattttaagaagcgttgtaccgccggatacccggaaatctattgctttaagagcgtctggtgcaaattctattttgacagaactttctaacgaagcagttgcagttagtattgaggatgctttgagattaaatgtatccgccatggctgcacaggtttatatcggttctgaatatgaacatcaatcgattaaaaatattattcaattggtcgatcagggtaatcgctatggaatgcctgtgatggcagtaactggtgtagggaaggatatggctcgtgatcaacgctacttctcactttcgactcgtattgccgcagaaatgggggctcacattattaaaacttactatgttgataggggatttgagcgggttacagcaggttgccctgtaccgattgtaattgccggaggtaaaaaattaccggaattggatgctcttgaaatgtgctatcaagcgattgatcaaggtgcagctggtgtggatatgggcagaaacatttttcaatctgaagcaccaattgcgatgatcaaggcggtgcaagcggttgttcacggtggagaaaatgcaaaagatgcctaccaactctatttaagtgagaaaaacaactaagttaattaggttggctaagttagccaacctatttttcccacgttttctatgataaggagaagcttatgtttgctatgcttgttgaaatcaatataaaagaaggtaaagaaaaagaatttcttgaggtttttgaacgtaaccatattggcactcgccaagaactgggaaatttgcgttttgacatattacgagatccggaaatacgtactcgtttttatgcatacgaagtgtatgaaaatgaaacagcactaaattttcatcggcaaactgaacattatcgccgttgtgtaagagaattagaatctttaatgactggttcaagaagtaagaaaatctttgaatggatattaccgaatccttatgtctaaattatcacttattcagcagttaaagcagcaaaaactgagtgttggtatcttatctgcaaattggcttcaacttaatgaagaggtaacaacattgttggagaatcagattaatgtactgcacttcgatattgctgatgggcaatttagttcgttatttacagttggagcaataggaattaaatattttccaacacattgttttaaagatgtgcatttaatggtaagagatcagttggaagtagcaaaagctgttgtagcaaatggtgcaaatttagtgacattgcagttagagcaatatcatgattttgctttaacgatagaatggcttgctaaacagaaaacaacttatgccaatcaggtatatcctgtattaattggagcctgcttatgtccggaaacgccgatttctgaattggaaccttatttggatcaaattgatgtaattcaattattaactttagatccgagaaacggaacaaaatacccttccgagttgattttagatcgtgtaatacaggtagaaaagcgattgggtaatcgacgtgtggaaaaattaatcaatatagacggctcaatgacgctggaacttgcaaaatatttcaagcaaggaactcatcaaattgattggattgtttctggttctgcgttgtttagtggagaattaaaaacaaatttaaaagtatggaagtccagtattatgtgacatcaataaaaagtgcggtgattatttcgtgatttttataaaataacttgctttttttgagatcatgagtataatctcaccactttcgatatgaaagtcgtttgatgtaatcatttattgaacgtactattacggtatgtaatagataaaatgtccccaatttggaggactaagtaggttcgctgcacttccctttatttaagatgttaaaggtgatggtgtcagtttttttatagctaattttattggagctctggtctaatgcagaaccaaagaatccgtatccgcttaaaagcttttgatcatcgtttaattgatcaatctacagcggagatcgtagaaacagctaaacgtactggtgcacaagtccgtgggccaattcctttgccaactcgcaaagaacgtttcacagtattgatttctccacatgtaaataaagatgcacgtgatcaatatgaaattcgcacacataaacgtttagtcgatattgtagagccaacagaaaaaactgttgatgcattaatgcgtttagatttggctgccggcgttgacgtgcagatcagcctaggttaattaagaggttattacaatgattggtttagtcggtcgtaaagttggtatgactcgtatcttcaatgaagatggggtgtcaattccagttaccgtaatcgaaattgaagccaaccgtgtgactcaagttaaaactcttgaaaacgatggctatactgcagttcaggttactactggttttaaaaaagcaagtcgtgtaaccaagcctgaagcaggtcatttcgtgaaagcaggtgttgaagctggtcgcggtttatgggaatttcgtactgagggtgaaaaattcactttaggtcaagaaatcaatgttgacatctttacagatgttaaaaaagtagatgttactgggacatcaaaaggtaaaggtttccaaggtggtgttaaacgttggaatttccgtactcaagatgcaactcatggtaactctttatcacatcgtgtgcttggttctattggtcaaaaccaaactccaggtcgtgtgtttaaaggtaaaaaaatggctggacatttaggtgctgaacgcgttactgttcaatcacttgaaattgttcgtgttgatgttgaacgtaaattattattagtgaaagggtctgtacctggtgcaactaatagtgatgttatcgttaaaccagcagttaaagcataagtctaggagatagagatggaattacaagttgtaggtgcaaacgcactcactgtttctgaaactaccttcggacgtgagtttaacgaagcgttaatccaccaagtggttgttgcttatgcagcaggtgctcgtcagggttctcgtgcacaaaaaacgcgtgctgaagtgtctagttcaggtaaaaagccttggcgtcaaaaaggtactggtcgtgctcgttcaggtgacattaaatcgccaatttggcgttcaggtggtgtgacctttgcagctaaaccacaagatcatagccaaaaagtaaacaagaaaatgtatcgtggcgcaatcaaaagtattctttctgaattagttcgtcaagatcgtttagtggttgttgaaaaatttgagatcgatgtaccaaaaactaaggttttagtacaaaaattaaaagatatggcgttaactgacgcgcttatcatcactgcaagtttagatgagaatctattcttagcggcacgtaacctttataaagttgatgttcgtgatgtgcaagctattgatccggttagcttaatcgcattcgataaagttgttgtaactgtagaagcggtaaaacaaattgaggagatgttcgcatgattcaacaagaacgtttgttaaaagtgttgagagcccctcacgtatcagaaaaagcaacaaataatactgaaaaatcaaatacaattgttttcaaagttgctttagatgcaaataaagtcgaaattgcaaatgctgttgagcaattgtttgaagtgaaagtagactcagttcgtacagtggttgttaaaggtaaaactaaacgtcgcggtgctaaaatgggtcagcgtagtgactggaaaaaggcttatgttactcttcaagaaggtcaatcgcttgacttcgttgaaggtgcagctgagtaatttcggaggagaaaaaataaatggctatcgttaaatgtaagccgacctccgctggtcgtcgtcacgttgttaaaatcgtaaaccctgaattacataagggcaagccttacgcaccgttattaggtaccaaatctaaaactggcggtcgtaataatttaggacgtatcactactcgtcatattggtggtggtcataaacaacattaccgtgtaatcgatttcaaacgtaacaagttagatatcccagcggttgttgagcgtcttgaatatgatccgaatcgttctgcaaacattgctttggtgctttacaaagatggcgaacgtcgctatattttggcacctaaaggtttatccgcaggcgatcaaatccaatcaggtattaatgcaccaattaaaattggtaactcgttaccgatgcgtaatattccggttggttcaacagtacataacgttgagttaaaaccaggcaaaggcggacaaattgctcgttctgctggtgcttatgtacaaattatcgctcgtgaaggtaattatgtgactttacgtcttcgttcaggcgagatgcgtaaagtattatctgaatgtgtagctactattggcgaagttggtaattcagagcatatgcttcgcgtacttggtaaagctggtgctaaccgttggagaggtgttcgtccaacagttcgtggtacagcaatgaacccagtagatcaccctcatggtggtggtgaaggtcgtaacttcggtaagcatcctgttacaccttggggtgttcaaaccaaaggtaagaaaactcgtcacaacaaacgtaccgataaatatatcgtacgtcgtcgtggcaaataatattaattaaattaagaggatatgccatgccacgttctctcaagaagggtcctttccttgacctacacttgttgaagaaggtagagaaggcggtggaaagcggggataaaaaaccaattaaaacttggtcccgtcgttcaatgatcattccttcaatgatcggattgaccatcgcagtccataatggtcgtcagcacgttcctgtttatgtttctgatgaaatgatcggtcataaattaggtgaatttgcaccgactcgtacataccgcggtcacgctgcggataagaaagctaagaagtaaggggtaagagatggaaactattgctaaacatcgttacgctcgcacttcagcgcaaaaagctcgcttagttgcggacttagtccgtggtaagaaagttgcacaagccttagaaattctcactttcactaacaaaaaagcggcagctttggtgaaaaaggtgcttgaatctgcaattgctaatgcagagcataatgatggtgcagatattgacgatcttaaagttgcgaagatttttgttgatgaaggtccaagcatgaaacgtgttatgccacgtgctaaaggtcgtgcagatcgtattttaaaacgtacaagccacattacagtggttgtgtcagatcgataatagtagaggaataacaatgggtcaaaaagtacatccacatggtattcgcctaggtattgttaagccttggaactctacttggtttgcgaatacacaagatttcgctgataatttagacggtgatttcaaagtacgtcaattcttgaataaagaattagcgaatgcttcagtttcacgcattactattgagcgtccggcgaaaagcatccgtgtaacaattcacacagctcgtccaggtatcgtaattggtaaaaaaggcgaagatgttgaaaaattacgtaacgcagtagctgctattgcaggcgttccggctcaaatcaacattgctgaagtgaaaaaacctgaattagatgcaaaattagttgcaggtagtattgcttcacaacttgaacgtcgagtaatgttccgtcgtgctatgaaaaaagcagtacaaaacgcaatgcgtttaggtgctaaaggcatcaaagttgaagtaagtggtcgtctaggtggcgcagaaattgcacgttctgaatggtatcgcgaaggtcgtgtaccactacatacattacgtgcggacatcgattataacacctcagaagctcatactacatacggcgtaattggcgttaaagtatggatcttcaaaggtgaaattcttggtggaatggctgcaattgcacaacaaccggaacaacaaccagccacgcctaaaaaggctccacgtggtaaaggtcgtaagtaaggagatttgctaaatgttgcaaccaaaacgtacaaaatttcgtaaagtccacaaaggtcgtaaccgtggtattgctgctggtacagaagttagtttcggtacctttggtttaaaagcagttggtcgtggtcgtttgacagcacgtcaaattgaagctgcacgccgagcgatgactcgtgcggttaaacgtcaaggtaaaatctggattcgtgtattcccagataaaccaattactgaaaaaccattagaagtccgtatgggtaaaggtaaaggtaacgttgagtactgggtagctttaatccagccgggtaaagtaatgtatgaaatggatggtgtatctgaagaagttgctcgtcatgcgtttgcattggcagctgcaaaacttccaattaagacaacattcgtaactaaaacggtgatgtaatgaaagctcaagaactacgtacaaaaactgttgaagagctgaatgctgaattggttaacttgttaggtgagcaattcaaattgcgtatgcaagcagccaccggtcagcttcaacaaacccatcagttaaaacaagtgcgtcgcagtattgcacaagtaaaaactgtattaaccgaaaaggcgggcgcataatgactgataaaattcgtacagtacagggtaaagtgattagtgacaaaatggataagtcatttgtggttgctatcgaacgtacagttaaacatcctatttatggtaagtttatccgtcgcactactaaactgcacgtacatgatgaacataacgaagcaaaattgggtgatgtagttgaagttagagggtgtcgtccactctccaaaactaaatcgcacactttagttcgtgttgttgagaaagcacaggcttaattgacaacgtatataagtaagaacctagcagaaatgctaggtttttggtttttttgatttatagaaatttttaaaattttactgctgataagcacgatatttaatataaattataactatattttaaaaatgattattgttttttagttttgtaagaaaatctgattctaaccttaaaattatttaaggataaaaaatgaaactatataaatttagaaaagaattatttgtattgactcttttagtctccggcaacagtatctcagcagagatcattgcggaattagatgaagttgtcgtatctgatagtagcagtgtagctgattttcaatcactcgctttccaaggtggtcgtaaagctagtgatgtatttattgagggtaaagagtttaaaacacgttctgccaccttaggtaatgctttagccggagaattgggcgtgcattctaacccctttggaggcggagcaagtgctcctgtgattagagggcaagaaggggtgcgtattaagcttttgcaaaatgggtcggatattgtcgatatgtccaatatttcgcctgaccatgctgtagtcgctgatacacttttagcacagcaggtcgaattggtgcgagggacatctaccttaatgtatggtatggcatcacctgctggtgtagtgaatattgtcgataaccgtattccgacttctcgtcctgagaaagggtatgagggagagatcgtttcacgttttgatacagcgagtaaagaaaaagtcttgaccgcaggggttaccttagcagcaggcgataatttcctgattcgtgccgaggggctgacacgcaaatcagagaattaccatgtgccagaggtatttattggtcaaaaattaaactacctaccggatagtcatcataaatcaaaagtaggaacgctaggcacaacttggataggcgataaaggctatttaggcgcctccgtaagttatcgtaaagaccgttacggtattcctgggcataatcatgcgtttgattattgttcagggcatttgtttgatacagataatttgaaagccattacagggggggatggtgaggcaccttatcttaatgcttacccacatttgatgacagatgctgatatgatttcttctctacatttccattgtggtgcggatatccaagggcataagcatagccatgaaagtatttatggacatgatcatgatattagtgaagcaggtcctgttgtggatatgcgttctaagcgttatgatgtaagaggagagtggaaatcacctattccagggattagcaaagtaaaactctcgcttgcttatgcagactattatcacgatgaaaagcatgatggcaaggcacatattgataagaatgattcgcagggcataaaagatagaaagaaatatacggctgccattatgtcaggaaaaccagaagctttttatgctaatcgtggatttaatagccgtttagagatttatcatcaacctacagagcattttaatggtgtagtagggatgcagtatcaaacacaaaaaactaaagtgcagcgtttagcgcctagtttaaataataatggacaagatttaagtggtgagagaaaagagtctgaacgtaatccattggtaccgcacacgaataagcaattcagtgtatttgcattagagcaatttacttggcgtaattttattgttgaagtgggggcaagatgggagaaacaacgcattccaatcaaatatgatccgcataaattacgtcttgataaagctgcaggttctaaagttcgtctaccagatttatctccttatactgaaaatgctttgtcatattcaggtactctaatgtgggattttcatccggcttatcgactgtctatcactggctcgcataatgaaagaattccatcaccaatggagctgtattatcatggtaaacatcttgcaacaaattcctttcaatatggcaataaggatttaaagaaagagcggtcaaataatgtagaaatcggtctgatgcgtatttccgacaaatgggattttaaagtcagtgcttattaccaacgctttaagaattatatccacaatgagaatttgtatcgcgagggcaacttatttatgcgtcgctataaccaatctcaggcaaggttctatggttttgagggcgaaatcggttatcagataacgcctaatcatagaattacgttctttggcgattatgtcaatggtaaactctttggttttaaaaaattctatggtaatccgaagtttaaaagggtatgtgaacttgagaatgatagaaaaaataatctcgagaaatgtgttgagaacgaagaatggggggaggaatggagctatcataaaattggagagcaaactatcgaacgtcccaaccgcaatgcagcccgtgttccccctatgcgcttgggatttcgtctaaagagccagtttaacgataattggtccggttcattggaatatacgagaatgtttgcacaaaaacgcatatccattaataccgtgatcaaagagattgatcgtgaggaagcagagaagcgaagagaaaatgcgaaagggcttgggtatgacggtcattatacagaacttgtccctgaagatgttacccaaggctatcacttactgaatctttctctcaattattcacgtaaaatagatggagtagaatatagtgcgacattaagtgcgaataatttgttgaatcaaaaaatctatattcataactcctatttgccttatgtaccgcaaatgggcagaaattttattttgaatgtcggggtaacattctagttgttcgtgaggatatcaaagagcggttgttttttgcaaaataaccgcagtatgttttctttaacgaaacctgttatctttttccaaaagttacttgataagtgcggtgctattgtgctaaactctgcgacctgtttaccatagggtagatgggttcgtcccgaaagggtgttttttattttaacggagcactaatatgatccaagaacagactatgctggatgttgctgataattcaggggctcgtagcgtaatgtgtatcaaggttctaggtggatcgcaccgtcgttacgctgctatcggtgatatcatcaaagttactgtgaaagaagcaattccacgcggtaaagttaaaaaaggtgatgtgttaaaagcagttgttgtgcgcaccaagaagggtgttcgtcgcccagatggtgcagttattcgtttcgatggtaatgcttgtgtgattttgaacaataacactgagcaaccaatcggtactcgtatttttggaccggtgactcgtgaacttcgttctgagaagtttatgaaaatcatctctttagctccagaagtactataaggagaaaatgtaatggctgcaaaaatccgtcaaaacgatgaagtaattgttcttgcaggtaaagacaagggcaaacgtggtaaggtaactaaagtgttaccaaacggtaaagtttttgttgagggtgttaatattatcactaagcacgaaaaaccagttcctgctttaggtaaagctggtgggttagtgaaaaaggaagcggcaattgatgtatcaaacgttgcaatctttaatccgacaacaaataaagctgaccgtgtaggttttagaattgaagatggtaagaaagtacgcttcttcaaatctaataatgaaattatttaaataactggagtaatgtgatggcgaaactgcatgattactacagagatacggtagtcaatgaattaaaagcaaaattcaactactcatctgtcatgcaagtcccacgaatcgaaaagattaccctgaatatgggagtgggtgaagcattgaccgacaaaaagttgctagataacgcagtagcggatttagcagcaatcagtggtcaaaaacctttagtaactaaggctcgcaaatctgttgcaggctttaaaatccgtcaagggtatccaatcggttgtaaagtaaccctacgtggtgaacgtatgtgggaattctttgaaagattgattactatcgctgttccacgtatccgtgacttccgtggtttaaacaccaagtcatttgatggtcgtggtaattacagcatgggtgttcgtgaacaaatcattttccctgaaatcgactacgataaagtagatcgtgtgcgtggtttagatattactattaccacaacagcgaaaagtgatgaagaaggtcaagcgttattagcggctttcaattttccattccgtaaataaggtaggttatcgtggcaaaacaatcaatgatcgcacgcgatgtaaaacgtgctaaattagctgataaattctacgaaaaacgtgaagaactaaagaaagtcatttctgatgtaaatacatctgatgaagaacgttgggctgcagtgttgaagttacaaacgcttccacgtgattctagtccagttcgtcagcgtaatcgttgccgtcaaactggtcgtcctcacggagttcttcgtaagtttggtttaagccgtattaaggttcgtgaagctgctatgcgtggcgaaataccaggtcttaagaaagcaagttggtaatttaccactttattttggaatcggagtaaaagcacaatgagtatgcaagatccaatcgcagatatgttgactcgtattcgtaacggtcaagctgcgaataaagttgcgattagtatgccttcatccaagctaaaagtggctattgccaatgtattagcggaagaaggttatattgctaacgttaaagtttcggaaggcgttaagcctgaattggaaattacattaaaatatttccaaggaaaaccggttgtagaaagtattcagcgcgtaagccgtcctggccttcgtatttacaaacgtaaaaacgaattgccaaaagtgatgggcggattgggtgttgctgttgtatctacatctaaaggtattatgactgaccgtaaagctcgtcaagcgggcttgggcggtgagataatctgttacgtagcttaagaagagaggtaggaaaatgtctcgtgttgcaaaagcacctgttagtattcctgccggcgttgaggtaaaacttgacggtcagctactaacagtaaaaggtaaaaatggtgagttatctcgcaccattcataactcagttgaagttaaacaagataataatcaattaacattctctcctcgtgtaggtattgctaatgctgatgcacaatcaggcacagcacgtgcattggtcaatgcgatggttatcggtgttaatgaaggttttactaaaaagttacagttggtgggtgttggttatagagcacaaatgaaaggcaatgtacttgtgctaagtttaggcttttcacatcctattgaccatgtgttaccagctggtgtaactgctgaatgtccatcacaaacagaaattgttctgaagagtgctgacaagcaattgattggtcaggttgcagctgatattcgcgcttatcgccgtcctgagccttacaaaggtaaaggggtacgttatgctgatgaagttgtacgtatgaaagaggccaagaagaaataattaaggtaacactatggataagaaatcagctcgtatccgtcgtgcagctcgtgcacgtcatatgatgagagagcaaggtgtaattcgtttagttattcaccgcacttcgcgtcatatttatgcacaagttattgcaccaaacggttcagaagtgcttgctactgcctctacagttgagaaagcaattagtgagcaagttaaatatactggaaataaagatgcagcggcagtggttggtaaaattgttgctgagcgtgcattagaaaaaggtatcaaaagtgttgcttttgatcgttccggttttaagtatcatggtcgtgtccagtctttagcggatgctgcccgtgaagctggtctacagttctaatagaggtaattttagatggcaagcatcgaaaaacaaactggtgaactgcaagagaagctaatcgcggtaaaccgtgtatcaaaaactgtaaaaggtggtcgtattatgagctttactgctttgacagtagtaggtgatggtaacggtcgagtaggttttggttatggtaaagcgcgcgaagttccggcagctatccaaaaagcgatggaaaaagcacgtcgcaatatgattactgtggctttaaatgaaggcacattacagcatccaattaaaggttctcacactggttctcgcgtatttatgcaaccagcaagtgaaggtacgggtatcatcgctggtggtgctatgcgtgctgtattggaggttgcgggtgttcgtaacgttctttctaaagcatatggttcaaccaacccaattaacgttgttcgtgcaactattgatgcattagcaaatatgaaatcaccagaaatggttgctgccaaacgtggcaaaaccgttgatgaaatcttggggtaattgatgatggcaaaaactattaaagtaacacaagttcgtagttctattgctcgtttaccaaaacacaaagctactttacgtgggctaggtcttcgccgtattaatcatactgttgagttaattgatactccggctatacgtggtatgattaaccaagtttcatatatggtcaaagtggaggagtaagagaatgcgtttaaatactctatctccggctgaaggtgctaagcacaatgcgaaacgcctaggtcgtggtattggttctggtttaggtaaaacaagtggtcgtggtcataagggtcagaaagctcgtactggtggcggtgttcgtcgtgggttcgagggtggtcaaatgcctttgtatcgtcgattaccgaaatttggttttacttcaatgaaatcagctgtaacagcagaagttcgtttgaacgacttagccaaagtagaaggtaatattattactttagatacattaaaagcagcgaatgttttaacaaaggatatccggtttgcgaaagtaatccttgctggtgaagttaaaactgcggtaaccattcgtggtttaggtgtaactaaaggtgcaaaagtagctattgaagctgctggcggttcaattgaggaataattaacaaatggctaagcaaccaggttatcaaaatagaagtactcaaagcggtactagtgaactaaaaagcagattattatttgtgctaggtgcactgattgttttccgcattggttctttcattccggttcctggtattgatgcggccgtgctggctcaattacttgaacaacaaaaaggcactatcattgatatgttcaatatgttctctggtggtgcgttgagtcgtgcgtcaatttttgcattaggtatcatgccttatatttcagcatcgattattattcaattattgaccacggttcatcctgctttagcagagttgaagaaagagggagatgcgggaagacgtaaaattagtaagtatacacgttattctactctcgcattagcaactattcaggcaatcggtatttctactggtctacctaatatgctacctgggttagttcctaatttaggttttagtttctactttacagcggtaattagtcttgtaacagggactatgtttctaatgtggttaggtgaacaaattacggagcgtggaataggtaatggcatttctttaattatttttgcaggtattgttgcagggttgccttcagcaattggtcaaactattgagcaagctcgtcaagggcaaatgcatctattagttcttttattgatcgcagtaattgtttttgcggtgacctattttgttgttttctttgaaagagggcaaagaagaattaaagtcgagtatgcaaaacgtcaacaaggtcgtcagatagtaggtggtcattcaactcatctaccattaaaagtaaatatggcgggagttattccggcaatttttgcttcaagtattattctttttcctgccacgttaacatcttggtttggacaaggttctaatttggaatggttaactgaattatcgctattattacatccaggacagcctttatatctgattgtttatgctgtggctattatattttttagtttcttttataccgcaatgcaatataatccgcgtgatacagcagataatttgaaaaagtctggcgcatttatacccggaattagaccaggtgaacaaacatcgcgttatattgataaaattatgactcgccttacattaattggcggattatatattacgtttgtatgtttagttccttatattatgacatcagcttggaatgttcagttttattttggtggaacgtctttgttgattgttgtagttgtaattatggatttcatcgtacagattcaaagtcatttaatgtcaaccaaatatgaatctgcgttgaaaaaagcaaaccttaaaggttttggacaataaatgtccatatagtaaaaaggataagtaatgaaagttcgtgcttcagtcaagaaaatgtgtcgtaactgtaaaattgttaaacgtgaaggtgttgttcgtgtattatgtagcgaccctaagcataaacagcgtcaaggttaattgatatttttcttgcaaagaaccagctgggtatatataatactcagctcatttatgtccttgatatgctgtttgagtatcctgaaacgggcttttcaagatcagtatatcaaatttaatcaataaaataataggagtgcatagtggcccgtattgcaggcattaacattcctgatcaaaaacatactgtaatcgctttaactgcaatttacggtatcggtaagactcgagctaaggcaatttgtgcagctgcgggtattgctgaagatgtaaagatcagagaattgtctgaagagcagattgataaactgcgtgacgaagttggtaaatttaccgttgaaggtgacttacgtcgtgaagtaacacttaacattaaacgcctattagatttaggttgctatcgtggtttacgtcatcgccgtggtttaccagtacgtggtcaacgtactaaaactaatgcgcgtacccgcaagggtccacgtaagccgatcaaaaaatagtcggggtaaggttaaatggctaaaacaccagttcgtgcacgtaaacgtgtaaaaaaacaagttgtagatggcgttgctcatattcacgcatctttcaataatacaatcgttacaattactgaccgtcaagggaatgctctagcatgggcaactgcaggtggttcaggtttccgtggttctcgtaaatctaccccgtttgctgcacaagttgcggcagaacgttgtgccgaagttgtaaaagaattcggtttaaagaacttggaagttatggttaaggggccgggtcctggtcgtgaatcaacaatccgtgctttaaatgcagcgggatttcgtatcacgaatattacagatgtgactccgattccacataacggttgtcgtccaccgaagaaacgtcgtgtttaatgacgtcataggatagttggagaaagaaaatggcaagatatttgggtcctaagctcaagctaagccgccgtgaaggcactgacttattccttaagtctggtgtgcgtgctattgatacaaaatgtaaaattgatacagcacctggtcagcatggtgctcgtaaaccgcgtttgtcagattatggtagtcaattacgtgaaaagcaaaaagttcgccgtatttacggtattttagaacgtcaattccgtaactattataaagaagcaaaccgcttaaaaggtaatactggggagaatttactggtattattggaaggacgattggataacgttgtttatcgcatgggctttgctgcaactcgtgctgaggctcgtcaattagtgagtcataaagcgattgttgtaaatggtcgtgtagttaatatcccatctttccaagtttcagttaatgatgttgttgctgttcgtgaaaaatctaaaaagcaagcacgtattaaagcatcattagaattagcagagcagagagaaaaaccaacttggttggaagtcgaagcagctaaaatggaaggtgtgttcaaacgtgttcctgagcgttctgatttatcagcagacattaacgaacatctgatcgtagagctttactctaaataatagttaaggctttgtagcaaagagaggataaaatgcagggttctgttacagaatttttaaagccacgtttagttgatattgagcaaattagttctactcatgctaaagtgatcttagaaccgttagagcgtggctttggtcatactctaggtaatgcattgcgtcgaattcttctatcttctatgccgggctatgcagttaccgaggtggaaatagatggcgtattgcatgaatatagtagtaaggaaggtgttcaggaggatattattgaggtacttctgaacttaaaaggtctagcggttaaagtacagaataaggataatgtttttctgacactaagcaaatctggaattggccctgttgttgcagctgacattactcatgatggtgatgttgaaatcgtaaatcctgatcatgttatctgccacttaacagacgaaaatgcgtctattaatatgcgtattcgtgtacagcgtggtagagggtatgtgccggcatcatctagagttcattctttagatgaagaacgtccgattggtcgtttgttagttgatgcttgttatagtccagttgatcgtattgcttataatgtacaagcagcacgtgttgaacaacgaactgacttagataagttggtcattgaactggaaacaaatggcacaatcgagccagaggaagcgatccgtcgtgctgcaacgattttagcagagcaactagatgcctttgttgatttgcgagatgttcgtcaaccagaagttaaggaagaaaaaccggagtttgatccgattttattgcgtcctgttgatgacttagagttgacagttcgttctgctaactgtttgaaagcagaaacaattcattatatcggtgatttggtacagcgtactgaagttgagttactgaaaacacctaatttaggtaaaaaatctcttacagagattaaagatgtgcttgtttcacgcggtctatcacttggtatgcgcctcgaaaattggccaccagcaagtattgctgaagactagtttggtcataggttaaagatttttctgagaaggataaggtcatgcgtcatcgtaagagtggacgtcaactaaatcgtaatagtagccatcgtcaggcactattccgtaatttagctagtgcattggttagtcacgaaattatcaaaactaccttgcctaaagcaaaagaattacgtcgtgtagttgaaccgttaattacattagcgaaagtagatagtgttgcaaaccgccgtttagcttttgctcgtacacgcaacatcgagacagttgcgaaattatttaatgaattaggtccacgttttgcacaacgtgcgggtggttatactcgtattttgaaatgtggtttccgtgctggtgataatgctccaatggcgtacattgagttagttgatcgtccagccttggctgaagaagctaaaacagagtaatttataactcatttaaaaagcccacagtaaaatgtgggctttttgtactaatcatatttattttctattctattccctatcatcaattcctatcaataaaaaatttccgtttatattacataaacttctgaatccaacattggtaattttaaaaggatttttatttggacgttttgtgtagtcaaagctctcatggtgatgaccgtgaaaaatatgctttacttgcattgatgtggctaaattattaataacagaaaatcctaaaggatgaggttttggtgcctcatgacatattagtatgtctgctttttgtttttctaatgcttcaatatcagaaggaaagattgaagttctatgacgcaatggaatacctcctcgccaaattttttccggaggagcgtattggcaataatggatatgatcaaaaaagagcggtttatttggtggcatccaaatttgtccacgaaacacgcctcctaatccggcaatttttattccttgaatgtcgacaactttaccgtgtaaattacgtgatttccattttgtaccccataaggcctcatatgctgaaactgttttgctatcatgatttccatggataaaccaaagatcacaaaactgtgccagtttatccagttcatcagaagtagttaattgtaaatcacctaaaataataagagatacatttgcatgttcttgaataaaagggtaaagatgggaataacttccatgtggatcaccagcaaataaaatcataatattattccttaaaaattgaaggtgtgattgtttccacggctaagtccaaaatttcttcgttgagtactttctcaacaatatttttcacttgattataacgttccaagtaactgggtgagtcaatttcaatataaggtacactatgcttatctaataatttttttaagagttgttggaagcgttgacgttgtttagcatttcctaagctacgcaagccatcatctacccattgggtattattatttaataaaatggtcacatcaaagggatattctttgatcatggagtctaagaaagggtgtgcttttccttcatactgaatacaaaatgcctgagttgtaataaagtctgtatctacaattgcaactttgtgtgcatgcctgagggcataatcaatataacgctgatgacctaatgctatttgtggataatcagaatattgcatagcttgttcattaccccccagtttttcaaaaacaaactcacgtccatattcccaagctgatgtagtattaaatactgtagccagtttattaacaagtgttgttttaccgctactttctccacctaaaatagcaattgtttttgcaaaaaatgggcgaacttctttaggaatgaatttccaatagtgaaatggattgttacgaatttttgttgcagaaatattaaggaatcggcgttttggatcaactaattcgacttgtaaatttaaatatttttcataaggtactttatcttggatttcactgctaaaaaccacgctaggattaacgtttttttccttgaatagacgttttacttgttcagcccatgcagaccagccatcgggataacttggtagaccatcttcaataagatgatgaataacaattttatttttctgatatttaaaaatctgttgcatccaacgtaagcgatcctgtacagttggcattcgtttcattttactgtcataaaatagttttaaatctcgttctgtatcgctacatacaaccacatgaagctcatctactttgctaaatgcttcataaatcatattaatatgaccggtatgaacgggataaaatttgccgaaaataacgcctatttttttgttatcttgttcagtgatctgtagtgctttatgcaatgctgaaagttttgtagcacttggatttttaatttttccactcactaattggttaaaataagcacgagtgatattggcttgtgtacaaagctcattaaccttcagatttaattgcttacgtttttgttgcagatagctgaaactcgacattattttctccttttctatttagggaatatttaatgagtagcataaaaagtgtggtaatcacttagtaagttttttatttttcttgtaattgttctaaacgtttctctagttcaatcagcttttcacgagttcttattaaaacttgtgtttgtacatcaaattcttctcttgtcactatatctagtttagataattgagattgtaagacttgttttagtttcatttcggcatcttgccctaagtcttttacaccttgagggagagaatcttgaatttgttgcataatttgttctatttttttaggatttagcataataagctccattttgatataaattgccccattgtatgcaatcttattcaaaataaaaacattttttcttattaaacgttaagatatactatacatgcattctcagggcagggtgaaactccctaccggtggtaaatatttcgatataagcccacgagcgcttacttatcttagtaaggtcagcagatttggtgaaaatccaaagccgacagtgatagtctggatgaaagagaatagagcgaggtattatacttatcgttgttgtttttctatttatctgatagaaaaaatccttttatcatcagccctgattctggtatctattaatttatttaaaggagtttactatgaatcagtcattattatctcagtttggtacatctgaagaacgagttaaacgtgcgattgaagctttcaaaagagggaacggagttcttgtccttgatgacgaagatcgggaaaatgagggtgatcttatttttccggctgaaacaatcacagttgaacagatggcaaaattaattcgttatgggagcggaattgtttgcttatgtatcactgatgaactttgccaacagctcgatttgccaccgatggtacaaaataacacaagtattaatcaaacagcgtttactgtgagtattgaagcggcacaaggtgtatctaccggcgtatctgcacaagatcgcgtaacgactattcaagtcgccattgctgataatgctaagccgcaagaccttagccgtccgggacatgtatttccattaagggctaaaaagggcggtgtgttagcacggcggggacatactgaagccgcagttgatctagcttcttgggcaggtcataagcctgccggggtaatttgtgaaataaccaatgatgatgggagcatggcaagaacactggagatcgtagaatttggcaaaaaatttaattacccagtggtaacaattgaggatcttgtccgctattcatcaagcaaagttgtttagctcgataaataagaacatcatcaattttttttcgttgttgatgctgtaattaaattgaaatttccctgttcccaacagtttgggtttctgtaaataaaaataaaatgaagactatgcaagatgaaaaatctgttaaactgtgtgctatttaaaatgggttaaaggataaaattattagtaacttaaaacgtgggtttgtcttacatcgacgggattatagtgaaaccagtttgttggtcgagttattcactgaagaacacggacgtttaacagtattggcgaaaggggctcgtgcgaaacgatcggcgtggaaatctttgctacaaccctttacacctttgttacttaattggtcaggtcgtggggaattaaaaatattaataaaagcagaggcgatatcattaactttaccgctacaaaccaccgcactttatagtggattttatgttaatgaattaattgctcgtctattggctccggaaaccgcatatccggatctttttcaatattatttgcaatgcttaactgcattggcaagctcaccgcaagaaatcgaaaaaagtttacgcacttttgaatttcaactgttggaggttttgggttatgccgtggatttttgtcattgtgctggttcggggaaaccggttgatgaaaagatgacttatcgctatcgagaagaaaaaggctttattgcttctttaattaaggataacctgactttttatggacgtgaattattagcttttgagcgtagagaattcgtcgataagaccgtcttgcaggcggcgaaacgttttagccgtattgctttaaaatattatttgggtaataaacctttaaaaagtcgtgaattatttacgcagaatattttacatacaaaataagttttactagatataaatttatggttttactttatcagccaaagaaacaaaaaaaattgagagcagcttttacgaccattgttcaagatttggattatcaaggattaggtgtagcaaaaattcaaggaaaaacgtggtttattgagaacgcattaccacaagagcaagtacaggttcaagttattgaagaaaaacgtcaatatggactgggtcgagttcaaaatattttacaagccagccctttgcgacaaactccaagatgtgcttattatcaaatttgtggcggctgtcaatctcagcatatccctatacatttacaacgtgaaacgaaacaaaaagcgttatttcagcgtttaaccaaactgcaaaaagaggctatagaatttatgccgatgataagtggcgaagcatggcattatcgccgtagagtacgcttaagtttgtactgggacgctaaaagtaaaaaattgaagataggctttcggcaaaaaaattcgcaacaaatcgtgaatattcgtcaatgcgatgtgcttgatcccttgttaaatgagttattacctaaattgcatgagttgttgagtacgtgctctaaaccgaaaacactaggacatattgaattagttgccgcagataatggcgtagcgatgttattgagagtaacagaaaaattggctgaacatgaccgcactttattgttggattttgcatttaatcatcagctgatgttatttgtacaagatgaaaaagagatttgtcatttacaaggagatttgccttattaccaattagatgatggttctattttacattttgatattcgtgattttattcaggttaatcgccaacttaaccaaaacatggtcaatactgcactggattggttggatttgaagaagaaggataatgtgttggatttattttgtggtatgggaaattttaccttgccgattagccgatatgtgaaaagtgcggtaggaattgagggtgttttacctatggtcgaaaaagcccgtcgtaatggggaacgaaatcattgtcataatgtccaattctaccagtgcgatttaagtcaatcttttactgagcaagaatgggcaaaggttccttttgacaaaatcttactggatccgccgagaagcggtgccgcatttgctttaaatgcattgtgttatttaatggttgaaaaaatattgtatgtgtcttgtaatccggcgacattagtgcgtgatgtggagcttttgcttaagtttggttatcaattaaaaaaagttgcaatgattgatatgttcccacatacaagtcatctggaaagtattagcttatttgaaaggaacagataggaagtaaagttatggttgcagtgcgtggttcacatttacttaatttgcaagattttgtggttgagcaatggagtaaaagtttatctttacctgaggatgttgaacaaaaattaatacaggcttggcgttatgcacagcaaaagtgtcttattgtacaaagtgaatcggagaaaaaaattgtttgttctctgcaagctggtgtggaaatggtggaaattctgcatagtttgaatatggatgcggaaagtttgattactgcaatgctttatccattggtgaaccataaaatgacttcccttatgcaaatcaaagaagattttggcagtaatattagcaagttagtgaaaggcgtagtggaaatggataacattcgccaacttaatgctagtcattcagccaacagtttgcaggtggataatgttcgtcgtatgttattagctatggtggatgattttcgttgtgtcatcattaaacttgcggaacgtattagctatttacgggatgtagaccgcttgtattctgaagaagaaaaagtactggctgcaaaagaatgttctaatatttatgcaccgcttgcgaaccgtttgggtattggtcaattgaaatgggaattagaggattattgtttccgcactttacaccccgatacttaccatgcgattgcaaacttattaaaagaacgtcgtttggaccgagaacaatatatcgcggattttgtgcaggagttacgtggttatctgaatgagaatttggatcaagtagaagtgtatggacgaccaaaacatatttacagtatttggcgtaaaatgcagaaaaaacacttggaatttagtgacttatatgatgtaagagcggtcagaattattgtacaaaaattgcaagactgttattccgctttgggcattgtacatactcatttcaaacatttgcctaaagagtttgatgattatgttgctaacccgaaaccgaacggttatcaatctattcatactgtcgtgttgggcaaaggtggaaagcctattgaagtgcaaattcgtactcaacaaatgcatgatgatgcagaattaggtgttgctgcacattggaaatataaagagggtgtaagtggaggacgttccggctatgaagaaaaaattgcatggttacgcaaattattagcttggcaagatgatattacagattctggcgaagtaatggcggaaatgcgtagtcaagtttttgatgatcgtgtttatgtcttcacgccaaaaggcgaagttgtggatttaccaacaggatctacccccttggattttgcgtatgctattcatagtgaaattgggcatcgttgtattggtgcgaaagttggtgggcgtattgtaccttttacttatcagcttcaaatgggtgatcaaattgagattattactcagaaaaccccgaatccaagccgtgattgggtaaatccgaacttaggttttacgcacacggcgaaagcacgtgctaaaattcagaactggtttaaaaaacaagatcgcgataaaaatattcctgccggaaaagaattgcttgaagttgaaattgcccgtttaggtatttccttaaagcaggtagagcaacacggattgcctcgctataacctgaagaatttagaagacttgtatgccggtattggtggtggagatattcgtctaaatcaacttattaactttctacaaaataaattaattaaggtgagtgcacaacaaacagatgaagaaattttgcgttatgtagccaataaaggtgctcattatgtgagtcaaaaacaaaaaacagagaaaaaaggttacgtgattgttgagggggtaggtaacttaatgtaccatatcgcccgttgctgccaacctattccaggtgatgatattatgggctatatcacaatgggaagagggatttctattcaccgtggcgattgtgaacagtttatagagttgcaaaatatacaccctgaacgtgttgttgagtcagtttggggcgaaaattatgccacaggtttccgcatcagtattcgtattatcgccagtgatcgaaacggtttattgcgagatattacaacagtattagctaatgaaaaaattagtgttttgggtgtatcaagtcgtgcagatacgaaaaaacaacttgcgactattaatatggaaattgaattaaataatgtacaaattttaagtaaaattctggcaagattagcgaaattagatgacataattgaggcaaaacgtctttagataagttaggtaaagataaaggtaaagataatgaaaaaaacaaccggattggagcattttataaaatcaatagtctattccttaaaagggttgaaaagcacgattcaacatgaaagtgcttttcgtcatgagcttgtggtttgttgtattttatttcctttagcgtttcattttgcacaaagcaaaattgagtttgtgcttatgattggttctttattattggtgctggttaccgaattgttgaatagtgcaattgaagttgtggttgatcgtattggaacggaatatcatgagttatccggacgagccaaagaccaaggctcagcagcagtttttgtcgccataatccttgcactatttacttggggagtgattttattttgttagcgtgttgacgtccgccctgccttcaggcagggcggatgtcaatagactagaaacgaacttccacggaagcggcaaaattgcgttttggtgcggtaaaacgattgatgccttcccctttaagtcctacagaacgagaagtaaagcctctggtaaaccataagttataggcactgtcccaagttgtataattacggttgaataagttaaaaatccccatatttaatgtaacatttttactcaggttaacttgtcccgttaaatccactacaaagtaagaaggacttaagaaaggccattgtttgacatttttagcaacatcaccacttttgttaccgccaagttcatattctgtttctatagcatctttggcttttttagccgcactgtaacgaccggttaaactgatactccatttttccgtttcataatcaattcccccaaccactgtccaaggctgaatggatttaagcggatcgccatcatgattttgccctttgctataactccccttaaggcggaatgttaatccatccgacagtcccaatgccgagccgttaacagcaccgctaacttctatccctttaattaccgctttaggctcattgacaaattgagctaacgaaataaactgtttcgaaccaccccaaaaactactaggattgtagtatggatttggcttacatctttcacgctcttggataaagttatgataacgtgtgcggaaaagcccgacgctaaaatgggcatattggttttggaaacggtaggttaattcgtggttcagtgcagtttccggttgtagaaacggatttggtttaaaattattagtagtaccactaccgtcacttacaaaatataaatcttcagcacgaggcactcgaaaaccggtgcttaggcggtagccaatttgatgtgatgggtgtacttgatattccaaccccaattgccaagacagatgggatagttttcttgaggggaagttgatgatagcattattgacttgccccttgagttgaggggcgtaattataacgatcataacgtccgccaatagtggctttcaatgtatcggttaaagcgacttcatcaagcaacgatagggaaaaaatacgagattttaccggaacaacttccgtataatttgggcgattttttttcattaaatacgaactagtagagaaacgttgagaattactgttttccaaaaattgatcacgaaattccactttgctggataagcgatgcgtggttcgccataatgctaatggataagttgataattctccacgagtaatagtttgatcttgaatgtactgataggaagcaagttgaaataattgattattcctaataccacgaagagctgaaagttgctcaattttctgttttgccacaaagagttttactgtttctaaccaatataagccattatatcgatattcgagaccataacggcggtatggtgttctgtctgtggcaaatcggttctcatcgttaatccccaatgttttttcttcggtaaatttcttttctgcacgatcttctaaaaatagtgtaaagcgatgggtgttattaatatcgtagccgatttttgttaaccatgaggtggtgtggtagctgagggggttgggtttgccacgacccggaccggtaatatccgcacctttgccattattgattgtttcatgcccccaacgtttggttaattgtgcaaaaccgaagaagcgatcagtcttgaaccccccccctatcacttgacgccattctctattttttgaggtataaccggttttggataagaagccgaaagtgcggtcaggttcgacaaaatcttcaatctctttggtggtaaaagaaaccgcaccccctaaagcaccgctaccattcatgacagaatttgcccctttctgtacttttaccgagctaatattttcatattccgtattattgatattgccattgtgacgttcggtagaataacgtgcggaagtggacattgttgattcggcttgcggtataccgtcaacaatcaccgcaacgcgatctttgtcgacaccacgtattgcaaagccgttactaccggaacgaccgccttcaggcacgccaatccccacttcatgacgaaataaatcacgttcattagacaccatatttttccgcaattgttcggaagattgagtagaggaaaaaataggctcaacattcgccacaacggatatttcacccaattcttccgctttgtggggttttgtttttgctggattcgaatcggcaaaacttaatgcaggaaacatcaagctacttgaaagaaataattggttgagaataatagaatacttagatttcaaaatgaaaatctccctgtaaaaaatataatagaaatgagaatggttcttataattataaatgccctaactgtcaagttttttaatcatttttatggaaagagtaagttatttgaatgaactatattgttgctaaacaaaacgttgcttgtgaaatgtatttttcactagcatttttaccaagagttcttgtattatatgagcaaaataagtatgccttgattcatatagatataaaagagttgttaaatattaatgcgataggatatgttaaaaaaattcattttacttgtcatcccgatgttgctaacggcttgtgcatcttcgttaaaagtgcttgaattaccacaagtaaaaacagacagcagactttttgtgattacacaacaatttcctcaatcggaaaaaagtttgctggcgattgaagttcaacctcatcaatggcgttgggtgcaaacagatccgctcggtgcacctattgctcgtcttattttgagtaaagcggggtggcaaaacgacggtttcgttatgccgaataagcaggcaaaacagcttttttctgcgattgcgacgtattttatgtcgactatgattttcgatgtccagcagatctcggaaaatgaatatgcacaaaaccatcggttaatatggcgattttctccgcaaaaacacggcgttaatattgagttgggggataagtctgtttggtttgtcgaacctttgagactgaattaaaattgtactaattatcagaaaataaaatgacggaaaccttatatttatcaaaacctgcgataatcagtgctatgggcgaagggctgaaaacgcatatagaaatgttattgaatgcggagcattccccgttagtgcattccgataaggtgtttagtcggcatcacattgccggtaaaatcggtgtcttcggcgagataaatttatcattacgcccatttccggaaaagcttagtgtacaacaccgtagtcgtaataatcaggtgttgtggcatgcattggcagatattgaaccgcaaattgagcaagctattcagcagtttggcaagcaacgtattgctgtggttattggtagttcaacaacgggtgtagatgaaaatatccctgttttcaaaggtggagcaagccaacaagattggtcgttagcacctttcaattttcagcaagtttcattttccgctccagcagattttgtggcggaagtttatggtttaagcggtttagtctatggtatttctaccgcctgtacttcgggtgctagagcgttaatcagtgcggctcggttattgaaaaataatttgtgtgatgcggtaatttgtggtggtgtagatacgctttcaccgctaacggtgagcgggttcaattctttatccgtgctttctgcacagcgtactaatccgttttctcgttatcgcaacgggataaatattggtgaaggtgcggcggtctttttaatgacgaaaacaaggttaaatgatgaaagcctaaaattgttcggctatgggtcgagtagtgatgcttatcatatgtcttctccgcatcctgaaggcgagggagcaatttccgcttttgagaatgctttaaaaaacgccaatgttaaggctgaacaggttggttggattaatttgcatggtactggcacggttcaaaatgatcacatggaaagccttgcggttgaaaggatcttcggagataagaccacttgtaccacaactaagggatatactggacatacgctgggtgcggcaggtgctattgaagcggcgattttgtggggtatgatcagtcgagattataatccaacgggtaaacttcccgcacaattgtgggatcaagaaaaagatgaaaatctgcccgcacttgctattacagatcgggatagttattggaaaatggatagacgtattggtgtaagcagttcttttgcctttggcgggaataattcggttttggtgttgggggagtagcatggttaatttgcattgtccgattacgcaagtggctcccttgctgccgcatagtaacgatatggtgttgcttgatcttattacggattttggcgaagattttttgatcgccgaggcaaggattaaaagcgataatattcttattcgagaaggtaaactcagtgcattttccggtatcgaaattatggctcaaggtgtggctgcttgggcgggatgtatggctgttcaagccaatgagctggtgcgtttagggtatttactcggcacgcgtaaattacatatttaccaagatgagattgcgatcggtagccgtcttcagattaaaataaacatgtccattcaagatgcgacggggtttggtgtatttgattgtcagcttattgatttagccgataatcatgtgattttggaaggggcattgaatgtgtttagtcctaaggaggaacaacaataatggcaaatacagtgcttattaccggctcaagtcgcggtattggcaaagcgattgctttaaaccttgccacacaggggtatgatattgtggtgcattgtcgttctcgtatagcggaggcggagaatgtggcacaagaggtgagagctttagggcaaaatgcaagagtactccaatttgatgtggctgatcgtgaaaaagtgcggtcaattttagaggcggatgtagaagaaaatggtgcgtattacggcatagtacttaatgcagggctaacccgtgataatgcttttccggcattgaccgatgatgattgggatagcgtgttacgcaccaatttagatggtttctataatgtgttgcacccgattatgatgccgatgatccgtcgtcgtcaagcggggcgaattgtgtgtattacgtctgtttcaggcttgattggtaaccgtggacaggtgaattacagtgcgtctaaagcgggacttatcggtgcggtcaaggcgttggctattgagttggcaaaacgtaaaatcacggtaaattgtgtggctccggggttaattgacacggatattctggacgaaaatgtcccgatagatgagattttaaaaatgatccctgccggacgcatgggcgatcctgaagaagtcgctcatgccgtgcaatttttaatggatgaaaaagccgcttatattactcgccaagtgattgcagtgaatggcgggctttgttaaagagcggtaaggatttcaatatttttattcacaattgaacattaacagcaaaaaggatacgaagtgaaacgggtggtagtcacaggaattggcggtatcactgcttttgggaatgattggcagaagataaaaacagcttttcaacgtaaacaaaatgccgtcaaatctatgaatgattgggttgaacgttttcccgaattggatgctcgtttaggtgcggttattgaggattactatcctccgaaacattggaaccgtaagcaattacgcagtttagggcgtgtttctcagctcgtagttgatgccagtgagcgagccttggctaacgcttctttattggacgaagacggtattattttagaatatctgaaagacggtagaatgggtgtggcttgcggttcttctaccggttctactaatgatattaaagatgcggcagaacttttgatgaccggtaagtcagacggtttcaacgccaacacttatgtacgtatgatgccccatactacggcggcaaatattggtattttctttggtttaacaggtaggattatccctacttccagtgcttgctcatcaggcagtcaagcgatcggctattcctatgaagccattaaatacggattgattcctatgatgcttgctggcggtggtgaagaattttgtccgtcagaggtttatgttttcgacagcctttatgcggcaagtcgtaataatgacaatccaagccatacgccacgtccatacgataaagcacgtgacggattagtgattggcgagggcggttgtatgtttgtgttggaagagcttgagcatgcattagctcgtggagcgaatattattgccgaagtggtcggttatggtgcaaatagtgacggtagtcatgttacccgcccgcaaaaagatacgatgcagcgttgtatggaattagccctgaaagatgcagggattgaaccgagtaaaattggttatgtcagtgggcatggtaccgctaccgaacaaggcgatattgcagaaacgcaagccactgaagcggtatttgggtatgttcccatgagttctcaaaaaagttatcttggtcatacgttgggagcttgcggtgcattggaatcttggttttccattgaaatgatgcgagatggctggtttgcaccaacgattaatcttgacaatgtagatgagcgttgtggtaaggtggattatattcaacatgatggacgagaaattcacacggattatgtcatgaacaataatttcgcattcggtggggtgaatacttctcttatttttaaacgctggacggatgaatagtggtaataagtcgctacatttcggggtgtacattatagaaattgctatggaattagctaaaattagcggcgttttgtaaagttgtggatagagaaaaagcgtatggcaaagatgataaatgatgggtgtaatatcgataatgactttgttcaaaagagtattaaacaatgacgcaacaaatctgtaatttttcatttaatcttcatgcgtggaatattgtctgtaataaagagctttccggagaggattggcaacaaggcgagcagtattggatggaaagtgttgctaaacgtgaaactgttgcacctaaactggcttttttaccgccgttaaaacgtcggcgtttaagtgaaagtgcacgtttattttttgaggcggcatggccattaaccgaacaagagaataatttgccggtggtgtatgcttcgctgaatggagaaatcaatcgtagctttgccttgtggcattctctcttaactgaaggagatgtgtctcctacttcatttagtctttcggtgcataatgcccttgttggacaatggtctgaaatgcgtcaggttaaaaatgaaacgacggctattaccgccttaaaagatagcttggaaattgccttattagaggcttttctactcttaaatgatggacaagaaaaggtgctggtcgtgctttcggaaacaccgttatcagtgaaatacaatgctcaacccgtggagcgtttgcctttgtcttatgcgttggcgatggtggtggaaaaaggctcgacttatcagcttagtttgcaatcgcaagctgttgaaagtgcggtattttttgataatgcacttgcttgggtacaacagcaatatttgggggcatcccaatggcaaacccaaagtagtcgtggaggaacttggttatggaagaaaaacttgattggctaaggcgttttctcggtacgttatttggttttatattgttcggtttcgtcggcgtgctgtttaaaattatcctttatccttatgcaaagcaatatctcaaggcagatttagctacgcaattaaaaggacgtaaaattgtcagtcgtacttgggcattttttgtgcgttatcttatttgggcgggtattttagaggttcgttaccatggttttgagcgattggggcgtaaaggacagttagttttagctaatcacccctctttgcttgatgtggtgctgatttttagtcaagtgccggagtttaactgcattgtgaaacaagatttgttaaaaaatcctgctatgagcagcccgataaaagcctgtggttttgtgccgaatacagaatcggaagaattattggaaatgagccatcggattttacaagaacaatccttattactttttccggaagggactcgtacaggttgggatggtgtggtgaaattacatcgcggtgcggtttctattgggttgcgtagtgcaaaagtgatcacgccggtggtgattaaaatgaccccgttaaattttaaaaaaggacaaccttggtataaaattcctaaaactaagattacgtatgaattaacagtgggcgaagatatcgatccgcaaaagtggtcggcggaaaagcccttgcctattgcctctcgccgtttaaatcaatacttggaagattattttaactcacaaacaaaggactaaataatggaacttgaattacaacttaaacaattaattattgacagccttgcacttgaggatattggtgttgaggatattgacactgatgcaccattatttggtgatgaggggttgggactggattcggtggatgcgttagagctgggattggcagtccaaaaaacgtttggtttacaattggatagcgaacaacaaaacttgcgtaatcattttgaaagtgtggcgactttagcaagttttattcaaagtcagaaacagtagaggaaaggaagtgaaatgacagaacaggaaattcaaaaggtgttgacggaagccttagtttcattatttgaaattgatgcggacaaaattaagcctgaaacaaatttataccaagatttagaaattgacagcattgatgcaattgatttaattgactatatcaaacgccaaaccggttataaattaaaggcggaagatttccgcaatgtgcgtaccgtcagtgatgttattgctgcggttcaaaaaatcagcgaaaacgcatagtcaagttgttgaggttgataaaacagcctttggggtcaagaccttgaggggggggatagtttggtgagtatagagcagcgacgcatgcaaagtgagcctgtgcagaatcctatttggttaagtgaaacacaagaggaaaatgtccaaattttccgagcgaaagtgccgccggatctgtgctatttcaaagggcattttgctaattttcctcttgtgccgggcgtggttgagttgcaatgggtgaaagagaaaatagatgcttactttggcaaagaaatgcagatgaatcgcattgataatttgaaattccaaaaatttcttcgcccaaacgatgaatttgagctcatattaaaatgggaagaaaacaaaaatcgaataggttttcagctcaaaactgagggcgaaatgtgtgccagtggtttcgtgattttcaaaaatggttaaattattcaatttattgattaacttggggttactgcttaccggcattggttatccgctggcgtggttttttgatgaaaaacaccaagggctttcgtatttagtagcaataatggcgttattatgggcaatcaaagcgataaaagcggtcagttttcatcggtttttggcaatcctaatggcgatattgcttggcatcgtttggcttactcgtagtttggaaacaatgtattggtatcctgtcatcatcagtacggcaatgcttattttatttggtggtagcttatttagctcacaatcgcttattgagcgtttcgctcgcctacaagattgcaacctttctcctcaagccgttagttacacccgaaaagttaccctagtctggagtggattttttgtgctaaatattaccatttgcaccgcacttatcctcgctggacaatatcactggtgggcatggtactcaggcggagtttcctatgtactaatggggttattgatgtgcatcgagcggttggttcgacaagaggtaatcaaaaatggataagcaacataatcaagggtatgcggattttgctttgcgttgtcagcaaatacgccaacagcttgaggaagatcgggtgaaagcggtggggttatggttagataatgccgatcaatttgcctgcgtgttattggcttgtttgaatgcaaaagtcaatgtgttgttaccgccgaatttactcaatgaaaaccttgaatggttggaacaacattcagcattactctttgataaaaaaatggttgagcaatttgggtgttcgcaaaaaattcaaaaaattcaaccgctcttggataagcagagtgaaagcgaaatttggctaaaaacttcaggtagtagtgggcaagcgaaaattattcataaaactactcgtcaaatgtgggctgaagctaaagccttagcctctgtcctaccatttaacgccaatgaacaaatttcagtcattggtagcgtcagtttgcaacatctttacggcttgactttccgtatatttttgcctttacaaatgggttggaaattaggtggtgagcagttacattaccctgaatatttactggcagaaagtcgtcattatcgcacgctttggattagtagccctgccttattgagccatctcaacttggcaagtttggaccagcatgtgcagattgcaggtatcatttcatccggcggggcgttacccgaacaaaccgcccttgctttgcgagaggaattgccttgccccgttattgaaatttacggtagtaccgaaaccggtgcgattgcttttcgtcagcaaaccggcgggctttggcaagctatgccgaacactcggttgggattaaatgatgaagaggcgttgtgggttgaaaatgcatggattgtcggacgagagcaaacggcagatgcggtgcaatttagtgagcatgggtttgaattactgggaagaattgaccgcattatcaaattgggtgataagcgtttgtcattggtgaaaatggaacaagatttgctcaagcattgttttgtacaagattgctatattgcactacattgcctacatcagcgaccactagcttgggttgctttaaataaagaaggtattgcctattttaaacaacaaggacgtaaggcagttatttcacaatttcgccaacatttacgcctgacccaagaaaaatttgctttgcctcggtattggcgatttacggacaaattacctcgcaataaccaatcgaaaatcagccgtttagattttgaaaaaatttgtaccgcacttgagtatgaggtatttgtatgacagcgtttaatcccattgcgatcattccccattataaccattctgcaacggtgggtagcgtcgctgaacagcttaatcaattagggctacctgtattgatcgttgatgatggctcaagtcttgaacataaagccgtgcttgagcaattgccgcaaaatgaacggttttcgattttattttgtgaaatcaatggcggcaaaggggcagctgttaaagcaggcttaaaacaggcacaaaaacttggatttagccacgctattcaagtagatgcagatgggcagcataatataattgatgtcaagaaaatgctcgaacaagcggaaaaatcgccgagtgcaatagtatgtggtaaaccgatttatggcaaagatgctccaaaatctcgcttatatgggcgaaaaatcaccgatttttggaatgcaatcaatacgttatcctttgatattaaagacgggatgtgtggttttcgaatttatcctattgctcaaattatgcccattcttgcacaagagcaaattggtggtggtatggattttgacacagaaattttaatccatagttattggcagaaaattccgcttatttgggttgataccccagtaaaatatgaaaaagatggcatctctcattttcgtggttgggcggataactggctgatcagcaaaatgcacgcacgccttttcttccgtatgctcaaacgactctttacaggaaaaattcgatgaataaacattgggcaaaacaacaagagcgtggtactgccttttttctaaccttaactcgtttaattgtgaagtatttgccattgcccataattcgagtagtgaatttttgggtggtgttatatttttatctcacttctcggcaaaaacggtgctacattgcagaatatcagcaaaaactgaccgctctttttcctgaaactaagttacctaaatatgcggtatttagacaatttctcgcttttggcgaagccattactgatcgtttcgccgtatggcaaaaaaaaattcgttatgaacatcttatcgttgatgatgcggataatctttatgcagatatcagcggcaatggccgaggacaaattttagtttgttctcattttggtaatattgagatctgtcgggctttgttcggtagcggacagcacgaaaattttaaactgaatgtactggtacataatcgacatgctgcagcatttaataaaacattgggtgatgcaggtgctgatgaattaccgctgattcaagtggaagacctcaatgtacaaaaaatgctggaacttgctgaaaaaattgatcgtggcgaatggattgcgattgccgccgaccgcattcccgtacgtggcgataaaacggagccggtcaattttttgggttctccagccgagtttcctcaaggtgcttggttgctggcaagtttattgaaagtgccgcttaataccatcttttgcatcaaagaacaggggcgttaccgtttgcagcttcgccgttttagtgaaagtattcaaggtcgaggaaaagtgcgtgaacagaatataagaaatgtcatgcaaaaatatgcggatttactggcaaaagaatgtgcaaaatcaccatttttgtggtttaatttctatgatttttggcatcgcaaagattaacttacttttctcaaggagattttatgaaactgatcaaaatattagctttaactttttctgcggttgtgattgttgcttgtgcacctcgtgatacaacccattatttatctattcaggaagccttaagttctcctgaggctaaaaaaatactgaatcctaaaatcaagctttattttggtaaacctgcaccgggtcaagtgattcaaaaaggggcggttaccaacccgaaaacgaatgcggtgaataaaacagataaagaagcgtgccaatgggtattcttatctgcagtgaaacgtttccaagatcaagcggtagctaaaggggcaactaaagtgggtaacctcgtgagttattacaagaaaaaagaatatagcagtaccactaaatatgagtgccatgcaggtagaagtattgctggtgtagcattaaaaggcgattttgttaagtaaagctattaataatctaggataaacaagcggtttaatttcttgaaaaaatgagcaaaattaaaccgctcttttgcttaaaatgaaactcaaaaaacacatttacgctgaacatttttccgactatgaaattccattttttgatgtagattccatgtttattatgtggcatgggcattatgtcaaatacttagagatggctcgctgtgcatttttagaagaaattcactatacctacgatgtgatgcgagaaaaaggttacggctggccaattgttcaacttcatttgaaatatgtaaaacctgccgtatttcgccaaaaaattcgggtgcatttagctgttgtagaatacgaaagctgtatccgtattgattacaccattactgatttagccaccaaacaaaaactgacaaagggtagtaccacccaagttgccgttgatatttcaaccggtgaaatgcaattacaaacgccacaatcttggcgtgatacgatagaaagctatcatgggtttattgctgagtgagagagagttaatgaaaaaatatctttttgtcttgttaatattattatgttgcaaaaatctttgggctttttctcaggatgatttagtacatttgttacaaaagccacagaatacgcaaggtgaatttagtcaacaacgttatttaaaagccttaaccaaacccattaccacttcaggaaaatttattttaataaaaaataaagggttggtttgggaaacggaaaaaccgtttacacatcaattgaaagtgacggcaaaaggcattagtcaatggaatggaacagcatgggaaaaccattctcgtttaggtcagggtgagcaaattaaactattcttaggcttattgtccggcgatattcaagcacttgcgacacaatttgacgtagtgctttcaggagatgaacataattggcaacttcagctcatgcccagcagtttgctgatgaaacaaatttttaatcaaattattattcagggaaatgtagctgtgcaacgtattgaattgcatgaaaaacagggagatcgtaccttgattttgtttaataatcagcagattaaccttccattatcaccctttattcaatctgtcttccaataggaatttgcatgcgcaaattattgaccgtttaccgcttaatttttgcaggggttttatgtcttgtggtggcgatttttatgtatcatttacaaacaggtaaatggttacaaacggatctacatacacttttgccggacagtcaacactatacaaaaattcaattagaggcagataaacatcaagaacagcaatttaatcagcaagttattgcattggttggacattcacaatcagaagctgcttttacattggcggaaaaagttgcagaacaatggcaacaaagtggtttatttcaaacgttatctgtaaaaaatcaaccgaatttaactgaacttcaacagcagattgagttattaaaattagccacactgcctatttcaacacgaaatcagattattcaacagcccgaacgttattttcagcaatatgcagagcaaatcattaacccgttcggtcatcaaaatttactgccattggaacaagactggcttggttttgggcgttttgtattgtcgcaatctcaacagcaaagccaaattcagtggcatgcagaaacaggtatgctctatgctgttcaacaaggtaagacatgggttttattaacaggcaaaattgttgattcagatttgatcaaacctcagcaaaatttaaccgcacttcttaagcaaaatgcacaatttattcaagaacaacaaggtcaatggttaagtacaggtgcggtgatttttgcggattattcacaacaacaagctaaatatgaaagcacgatcatgggcgggttaggtatcagcctaaccttgcttttactgttgctggttttccgtagcttacgcatattatggttatttttaccgatttctgtaggtatggttgcaggtattactgctactattagttgctttgggcagattcatattttaacgctcgtgattggcacgagtttagtgggggttctgattgattttccattgcattggctgacatcatctctctttttgcgtcaatggaatgccaataaagcgatggcaaaacttcgccttactttttttgtcagcttattggtgaccttgctgggttatgctttactgggatttactgctttacctatcctaaaacagaccgcacttttttccggtatggcgttgatttttgctgtcttaacgaccttcttgtatttgcctctatttttccgacattaccagtcaggtaagtcgttgtttttacgccgaattttgcaaataaatttccacgttaagattaattcattattaaataagattttatttgtggttagcacgggtttcattgtagtagggttgcagaaaagctattggcaagatgatattcgtcaatgggttgctatgccgatggaattgattgagcaggcacaaaaaattcgtcaaattaccggcattgatctaagcaatcaatacttattaattactgctgaaaataatgagcaattattgcaaaaagaccgaattctaaccgagaaattacaacggttcgcacaagaaaataatctgataaaatttcagtcattaagccaatggattatgtcaaaaaagcaacaagcggagtttattcaacagctaaaaaatattcctgctgaaagctatagcgtttttgatgaaattggtattccaaaggacatgattcgtcattcgctaaaaaaattggaaaaacagcctcttgttagcttagaacaggccttaaatacagaattgggaaaagtttggaaaaatctatatttaggtgagcttgatcgaggaaaagtagcaagtattattaaagtatcaggattgaataacccaaaaattcttgagcaaattgttaataatcgggatatttactggcaggataaacctgcccatctcaatcagttgtttgagcaaacccgcaaccaagcggcttggttaaaattgctctcatttggcttggcagctttattgttgtggcgaatgtttggcatatcgcaaacgttgaaaatgctcagtatcccgcttatttcagttgtgtgtacagtcgcaattttaggttggttaaatatcaccatcagtttgtttgctatgtttgggttattattggtgtcggtcattggtattgattacattgcctatatgcaaacagcgaaagagccgttatcaataaaacgttttacgattagccttgcagcacttaccacgcttatttcatttgctttattagggttaagttccactccggcggtagcaagttttggcttgagtgtcagtttgggtgtgttgattagcttaggaatgattttgcgaataaagtgaagtaatggtgaatatattttcacatcctatcttatggctgattaattgcgatagatatatcatttttatggcaaaacaggattgcataagcactaaaactcaaaaagggctgatgtcagccccttgttgttagcatcaaattaaaataataccctcgcacgaatagtgccttcaatttgcttaagtttagccaataattgagcggtatcttctgtttcaacatcgattaccacataaccaatttttgcctcggtttgtaaatattcagctgcaatattgatattttgctccacaaatatttgattgattttatttaaaatccccggacggttatggtgaatatgtaataagcgttttgcattactatgttccggtagagatacttctgggaaatttactgccgatagtgttgaaccattatcggaatatttgacaaatttatttgcgacttcaattccaatattttcttgtgcttcaacagttgagccaccaatgtgtggtgttaggataacattatcaaaagcacgcaatggcgagataaactcctcttcaatcgaggcaggttctttcgggaatacatcaattgcggcaccacgaatttttttgctttctaacgcctgagttaaagcgtcaatatcaaccactgtgccacgggcagcattgataaaaatacagttcgcctttaattgtgcaatgcgttctgcattcattaaattttttgttgaggaattttccggcaaatgtaatgaaaccacatcacaggtactcaaaagttcttctaagctattcatttgttgtgcattacctaaaggtaattttgtttctatatcatagaaatacacattcatgcctaacgcttctgcaataatacttagttgagatccaatatgaccataaccaataatacccaagcgttttccacgaacctcataagatcccaccatggatttattccataaacctcgatgcacatcggcattggcttgcgggatattacgcattaataataagatctcaccaagcaccaattcagccacagatctggtattggcaaacggtgcattgaaaacaggaataccacgtgcttttgccgcctctaaatccacttgatttgtgccgatacaaaaacaaccaattgcaattaattttgttgcttctgctaatatatcctccgttaaagacgttcgagaacggataccgataaaatgtgcatctttgatagcaatttttaattcttcaggttctaaagccttccgatgatattcgatattggtatatcctgctgcttttaacacctctaatgcattttggtgtattccctccaaaagcaaaaacttaatttttgatttatctagtgatacttttgttgtcatattgcctctccgtatatttaaataattattcaataatttttgtaccctccggcgtacctacaataacaatatctgcagaacgtaaagcaaaaatcccatttgttaccacgccggccacattattcaattctttttccatttctatcggattcataattttaaagttatatacatctaaaataacattaccattatctgtaagcacattttcacgatattcaggtgaaccgcccaacgccactaatttgcgtgcaacttgagagcgagccattggaatcacctctatcggcaaagcgaacgttgagcctaatacatccacttgtttagaactgtctactatacatatgaatttttttgccaatgcggctacaattttttcacgtgtcaatgctgctccgccacctttaatcatcattttttgcggattaatttcatctgcaccatcgacataaatatctaaaccggatacatcatttgcactgaatacctcgataccttgtcggagtaataattcttctgacgcttttgaagctgcgacagcacctttgattgtttcttttattgtacctaatacttcaataaaacaattgacagttgaaccgcttcctacgccaataatgctatcaggtttaacatattgcagtgcagcttgagcagccatttttttcatgcttaactgatccattttttatcctttttctatgattttatgtttatgtcgtacaaagcaaatgtttttataagttcactactttaaaactattcacttaaatacacaagctaatcaggcaaaaactccgttaataattcattaaggaaaagttttccttgttcagtgatttgccaagtgcggttcgtttctgataaatagttcttctctaacgcccaatcaatttgtttttgtaccgcactttgtgctaatccggttaacagttcaaattgttgtttttccataggttccaataaacgaaagcgattcataaaaaactcaaatggacgttctgaaaaagggatatttttttcctcatatagatattcaccacgcatatagcctttagggtgtttcgttttagaaaaacgtaaaatttgtccatcagcaaaactcaatttaccatgtgctccacacccaatagctaaataatcaccaaatctccaataattcaaattgtgttgacattgaaaatcaacttttgcataagcagaggtttcatattgttggtaacctgctttggataacaattgatgaccctgctcaaaaatatcccaaagttcatcttcatcgggtaatttcggcggacgatatgcaaacattgtattaggctcaattgtgagttgataccaagataaatgaggcggtcttaaagcaatagcttgctgtaaatcgtccagtgcttgcaccaaagattgattgggtaatccgtgcattaaatccaagttaaaactgtttaatccggaatgttgagcaaaacgcaccgcactttttgcttcaactgcattatgggcacgccccagtctctgtaatttttcattattaaaactttgaatccctatagaaattcgattcactccggcttgtgcatatccgacaaaccgatcgctttcagctgttacaggatttgactcaagcgtaatttcaatattatcctcaaaaggaataagttgtttaatttgattcaataaataatcaatactttgtacagaaaataggctaggagttccgcctccaatgaaaatagaatgcaattttcggtcggctattgaggcatgataacgtaccaaatcttgctttaagtcactaagcaaatgggtaacatattcagtttccggaataggccccttttgtgcatgggagttgaaatcacaataagggcatttttgtacacaccaagggatatgtatatataaacttaatggaggtagctgaatgggaaatagtttaacaagggagaattgtatcattatttcaaccgctcttttaatactgcgagagctttggctcgatgtgaaattttctttttctccgatgtttccagttcagcaaaagtacaacctgtttcaggatagaaaaataagctgtcataagcaaagccatttgaaccgctttcagaaaaagcaattattccatgacattcaccttcagcaataattggcgatggatccgtgtcatgttgcagcatgacaatacaactcacaaatttggcatgacgctcattaacgggcacattagccagttccgctaataacttctctctatttttctgctccgcatctttgccctcaactccggcatagcgagcggaatataatcctggtgcaccgtttagtacaggaacaaccaatccactgtcatcagcaatcgcaggtaagcctgacatttttgctgcataacgtgcttttagaagtgcattttctacaaaagtcaaacccgtttcttccggactgtcaatacctaaatctttttgtgcaacaacatcaaaaccaaattcagataatacatctgccatttcttttactttcccaggattagctgttgctagtacaattttttgtttcattaccgttcctttttcaatgaataaccagtttgctattttaagcacttcgcaggtattttttaagatgctgttttaagataagtcccctgaatgataaaatatttttgcttcctacagaaatatcccctcaacattgttaaaaattgaggggatattgatttatattgtcaaaagttatttggcatgtgtctagaaaatgatgcgatctctatttttttctagtgttgctttgccaatccccttgacttcaagtaactgttcagccgcggtaaatttaccaaatttttcacgatattgaacaattgcctcggcttttttgcttccaattcctattaaagcgtgtttaatttcttccgctgttgcagtattgatgttcaatttatcgctaataatgaccggttcaacttgttgtgttgcttgggctgaactaggtggttgagttggtgtttctgcaaatgcattaaaagcccccaaagcaacacttaacatcaataatgatttgaaaaatgaggttatttttttcattttgtcttccttacagtaaatgataaccaaagtttaaaaaattgaactgttgaattgattcaacaacagacattttgcatggaggcgaaaaacttacgagaaaatcactgcacttttacgatcaggatcgcaaaaataacaaaaggggggagtaaaaagagaatttttaatgaaaaaacgagtatttgctaaaagcgaatactcgtttttttgaagagaaattattgacgtactgcgatagcttcaatttcaataccgacatcttttggtaagcgagctacttcaacacaagaacgtgctgggaaagttgggtgattattttccacaaagaaacgctcatattctgcatttacggttgcaaattgatttaagtctttaacaaaaacagttgttttaacaatatctgctacggtcaatcctgcctgtgcaagaattgctttaatattttccaaagattggcgagcttgtgtcgtaatatccgccggaatttctcctgttgcagggttaaccggaatctgactggaagttaaaactaaattacctaaatccacagcttggacataggggccaattgctgccggtgctttttttgtgtgaataatttttgtcattttttctccttaattcaacgatattttcacgctaaccattgtacgcttttaaaaataaacttaaagcccattcatggcgtttatcaagcgaatttcttcatattgtgccagatcctcgaaaaaaatttctcttgcaataattttcttttgctcaagtaattttgctcgttgtgtaccttctaataacggtttatcgggagttatccattgattattttggcgaaaaatcaagtttccaatagagcaatccgttactttgccttgacgaataatcataatttcatcacattcttctttttgttttaagaggttgtttaacaatgttcgatctgaaaatttcaaactgtaatcaatatgatcacagaaaacaggtttaaaagttcgataaactttttgttgataaggaaagcattgaagaacgtaatcatgatggttgtaatcaatacggcaacgtattaagccttctcggtgggtgaaaagtgtggtatgtttagcaataatttttgctaaatcaaatggttgtaatttcattttgggataaaacttcagcaggcttttttcataacgttgctgatgataggaaatatttttagcttgaccttgttcaattaagatcgtttcaaataaaggaaattgccacattttctgttaataattatcaaatattcatatctgcatcaaaaattatttctctacttaaatcttgagataaagaaataaaagctagctacttagttttcctcactattggataaaccgctgtttaggctctaaatagtccttaattcgcttattttatgaggggtaaatatactttagcacacagctcgttgtattcatcttctatatcactttgaattgtaatgccacctccgctacgaaaataatagccatcgctccgtttctcaataaagcgaatagcgaccgcactttgtaaggtttctccatcaaaaataccaaaaacaccggtgtagtaacctctcttttgctgctccgcttgttgaataatttccaccgttttttcttttggtgcaccgctaatagaacccgccggtaatagtgcggctaaaatatgtccaatattatgtcgccaattttcctctaactcaccacaaatttcggaacttgtttgcaaaattgcacctcgttcagtatgaattttttcaacatagcgaaaacgtttaacttcaatatttttagctacaatagctaaatcattacgcattaaatccacaatggtatagtgttcacgcaactctttttgtgaatttagtaattgttgctcagcattttctaacgttgcatttatcgtgcccttcattggataggtgtaaattttattttcataaatttgaataaacggctcaggcgaaaaacaaataaattcatttttaaacaataacttataacttgcttttgtttgttgaaataactgtatcaaactataatttgtttcaattttgctcggataagtaagatttaacaaataagagttacctttttgtaactcgctcttaaccagctcaaatccctgctgataatctttaaatttcataggattaaatgaaaaatgacaatcttttgcggaaaattcaaaatgccaatctacattactttttattccttgcggttgtaaaatagtaaaaaagatattttcttttgctgcttgttcaatgggtaaaataattggtttttgctgttcaaaatcaatcaaaaagaaaaaaggtaatttattttgcccaaaataattcgcttgttgggcaaaatcacgaaattgacttgagttattcaatgacatagtgatgaaaaatttagtaatatacgtaatttgctgattttagcttaagatgaaacatgaacacaaatttattagtcattaataatcatgactcttttacttataacttagtggatctcattcgccgtttaggtacgccttttaaagttgtgaatgtagaggatttatctttggtggaaatagaaaatttttctcacctgttaatttctccgggacctgatgttcctcatgcatatccccaactttttgatttactggaaaaatatcatcaatctaaatctattttgggtgtttgcttaggacatcaaactttatgtgaatttttcggcggaaaattgtataatttgcagaatgtacgtcatggacaagctaaacagctaaaagtgcggtctaattcgagactatttagaaacttacccttaacatttcaaattggactttatcattcttgggctgtaagtcctgaaaactttccggaagatcttgaaattactgcgatttgtgatgatgaagtaatcatggcgatgcaacataaaaccttgcccatttacggcgtacaatttcatcccgagtcttatatttcggcgtttggtaagcaaatcatacaaaattggctaagcaattgataattatcataaattcataataactattaaaaataaaaaaatgatagaaatttcctatgaattttatcaataatatccattttgttagtaaggaattattatttatcatataatcagtaaagacatcaataaacataaataggagaaagcttatgacaacaactatcggtttagatcgcaatagttcaaaacaattagcaacagaattaaataatttattagcaagttatcaaatattctacatgaatgtacgtggctatcattggaatattaaaggtgtaaatttctttgaattacacgcaaaatttgaagagatttatgatgatttagtagtgaaagtagatgaaattgcagaacgtattttaactttaggttataccccaagtaatgcgtttagtgaatatttgacacaatcgcaaattcaagagcatattaatgtaactaacgcacaggactgtttaaacggtaccctacaagggtttaaaacattgttaaaacaacaacgtagtatccttgcgattgcatcagatgccaatgatgaaggtaccgcttcgcaaatgagtgattatattaaagagcatgagaaattaatttggatgttcagtgcggcttgtgaaagttgtcatgcttaatttgtgtaatatcacatcattttaaatctaaaagttaaaataaaacctctagctgtgcctagaggttttttcgtttatatgaaaagctaaatattgtgtttatttgccgatacagaaagagctaaaaatattgcctaataaatcatcggaagtaaattgtcctgtaatttcacttagatgatgttgcactatacgcagttcttcagcgagtaattcacctgcataaaattctgtcaactgaatcaatccggcttgtaaatgaatgtcggcttgttctaaggcctctaaatgacgacgacgggctaaaaatcccccctcagtgcagacttgatagcccatggactgttttaaatgctgacgcaacaaatcaacacctttttgtgtttttgccgacaatgaaataacagttaaaccgttttgttcatctaaaacttctgcttcaccacttaaatcagctttgtttcttactatggttaaaggaatatgtggcggtaattttgccataaattcagaccgcactaaatccagttcaacttgattttccgtgctatccaagattaacaaaatacgatcagcctgttcaatttcatcccaagcacgacgaataccaattttttcgacctcatcggttgcatcacgtaaccctgccgtatcaataatatgtaaaggcattccgtcaatatgaatatgctcacgcaaaacatctcgagttgttccagcaatatccgtaacaattgccgcctcacgccctgctagtgtgtttaataaactggattttccggcatttgggcgaccggcaatgactactttcattccttcacgtaaaatagccccttgttttgcctcattttttactttagctaacttggctattatttcacgtaaatgcgtttcaattttaccgtctgcaagaaagtcaatttcttcgtcagggaaatcaattgccgcttcaacataagtgcgtaaataaataactgagtcaactaattcattgattttatttgaaaactcaccttgcaatgattttaatgcagaacgtgctgcttgctccgaactcgcctcaattaaatcagcaattgcttctgcttgagctaaatctaatttatcattaagaaacgcctgttcagaaaattcccccggtcgtgccaaacgaataccgtcaatttgcaaaatacgttttaataaaagatccatgacgatttgtccgccatgtccttgtaactcaaggacatcttctccggtaaaagaattgggagctttaaaataaagtgctatcccttgatccaatacactaccatcagaatctttaaaaggaagataatttgccatcctaggtgttaaggttttaccgagtacttgttcagcaacctgctgagctaaaggtcctgatacacgtaaaatcccaactccgccacgtccaataggcgttgcttgagctacaatagtatctctactcataatttgttcccaaaagtgcggtcaaaaatcgtatagaattataacaaaaaaggcatcatctaagatgcctttcttttatttaggattatttttttactctggtatgtaagccttttttctccaagccacgataaattaaccattgttgtgcaatagtaataaggttagaggctaaccaatataatactaagcctgcggggaagaataagaagaacaccatgaaaattaatggcataaacgtcatcaccttttgttgcatcggatcggcaacaggtgttggtgatattttttgcaataggaacattgaggcacccattaggatcggtaagataaaatacggatcctgtgcggataaatcttgtacccaaccaaagaatggggcatgacgtaattcaacggcttccataaatgtccaatacaaagcaatgaaaattggcatttgtagaagaattggtaagcaaccgccaagaggattgactttctcttctttgtaaagtttcatcatttcttggctcatacgttggcgatcttcaccaaaacgctcacgcatttcttgcaatttaggttgtaacatacgcatttttgccatcgacgtatattgtgctttggttaacgggtatagaattgcttttactactaaagtgacaccaataattgccagcccccagttttgtacaagagattggattagggttagcaatttaaatagaggtttcgcaataaaccaagcccaaccataatcaacggttaaatccaaatgattagccacatcagccatttgatcttgtaatttcggaccagtccataattgagtatgaatagtttcagttgcaccgttttctattacaatcggagcagatcgataaccaatagaacccaagtgtttcttagtatttgtcagcgtgtacaaggtattattagcatcctgattaggaatccaagcggagacgaaataatgttgcaataaggcaacccaaccggctttggtatgaatatctaaatctgctttttccatgtcttcaaaactatattttttatagttggtttctgacgatgaataagcaccgccggtataagtcggcattgccatgctacctgaactttcaactagcgtatgagttaattgtgcataaggaactacttcaatcggtttttggctttggttggtaatttcaaaattgacctctaatgcgtaagacccgggttttaatacaaagactttacgatagatcacaccatctttctcaaagaccaaaggcacttttaattcctgttgaccttctgctaacttaaatacatcaccttcaacttggtaatttgcacgaccagcacgactatcaataccattttttccgactaagccgctttgtgcaatatatactttatccgcattgttctgtaataagacgaaaggtgctgaagaatgtaattctgcatcatagttcaataattcagaaccgatcacgtcccccccaaaagtatttacctttaaacggaaaacatcattttctaatgtaataacacgacctttagcctgtgtatcattagcaatatctgacgttgctgtaagtgcggttgagtttacttcagaaacctgagcttgttcagtcatttccggcttaggcgtgttatagtctacttgccattgctgataaataaggaaggaaatgaaaagaagtgccataaataataggctgcgtttagaatccattattcgttctctttgttgttattaatctttgggggaacaggatcgtatccgcccacattaaaaggatgacattttaatatacgtttaactgtaagccaactaccttttactacaccatgcgtttttactgcttgaataccataacaagaacaagttggcacaaaacgacagcgaggaccaatcagcgggctaatcatcaattgataaatcctaattgcaccaattaagacttttgcaccaaacgaatgtgacgtttccatagcttatccaaagtttgaaataattgctggttatctaaattaccaatacctttctttgttattattacaaaatcataattagccagctgtccttgtaataaacggaaactttcacgagaaatgcgtttaa
